US010363301B2

(12) United States Patent
Mascola et al.

(10) Patent No.: US 10,363,301 B2
(45) Date of Patent: Jul. 30, 2019

(54) STABILIZED INFLUENZA HEMAGGLUTININ STEM REGION TRIMERS AND USES THEREOF

(71) Applicant: The United States of America, as represented by the Secretary, Department of Health and Human Services, Washington, DC (US)

(72) Inventors: John R. Mascola, Rockville, MD (US); Jeffrey C. Boyington, Clarksburg, MD (US); Hadi M. Yassine, Boyds, MD (US); Peter D. Kwong, Washington, DC (US); Barney S. Graham, Rockville, MD (US); Masaru Kanekiyo, Chevy Chase, MD (US)

(73) Assignee: The United States of America as represented by the Secretary, Department of Health and Human Services, Washingron, DC (US)

( * ) Notice: Subject to any disclaimer, the term of this patent is extended or adjusted under 35 U.S.C. 154(b) by 0 days.

(21) Appl. No.: 15/313,265

(22) PCT Filed: May 27, 2015

(86) PCT No.: PCT/US2015/032695
§ 371 (c)(1),
(2) Date: Nov. 22, 2016

(87) PCT Pub. No.: WO2015/183969
PCT Pub. Date: Dec. 3, 2015

(65) Prior Publication Data
US 2017/0202946 A1    Jul. 20, 2017

Related U.S. Application Data

(60) Provisional application No. 62/003,471, filed on May 27, 2014.

(51) Int. Cl.
| | | |
|---|---|---|
| *A61K 39/145* | (2006.01) | |
| *C12N 7/00* | (2006.01) | |
| *A61K 39/12* | (2006.01) | |
| *C07K 14/005* | (2006.01) | |
| *C07K 14/47* | (2006.01) | |
| *A61K 39/00* | (2006.01) | |

(52) U.S. Cl.
CPC ............ *A61K 39/145* (2013.01); *A61K 39/12* (2013.01); *C07K 14/005* (2013.01); *C07K 14/47* (2013.01); *C12N 7/00* (2013.01); *A61K 2039/55555* (2013.01); *A61K 2039/55566* (2013.01); *A61K 2039/6031* (2013.01); *C07K 2319/00* (2013.01); *C12N 2760/16122* (2013.01); *C12N 2760/16134* (2013.01)

(58) Field of Classification Search
None
See application file for complete search history.

(56) References Cited

U.S. PATENT DOCUMENTS 9,441,019 B2 *  9/2016  Nabel .................. A61K 39/145

FOREIGN PATENT DOCUMENTS

| WO | WO 2013/044203 A2 * | 3/1928 | ........... A61K 39/145 |
|---|---|---|---|
| WO | WO 2013/044203 A2 | 3/2013 | |

OTHER PUBLICATIONS

Steel et al. (MLBO, 2010, p. 1-9).*
International Search Report and Written Opinion prepare by the European Patent Office dated Aug. 25, 2015, for International Application No. PCT/US2015/032695.
John Steel et al: "Influenza virus vaccine based on the conserved hemagglutinin stalk domain", MBIO, American Society for Microbiology, US, vol. 1, No. 1, May 18, 2010 (May 18, 2010), pp. e00018-10.
Masaru Kanekiyo et al: "Self-assembling influenza nanoparticle vaccines elicit broadly neutralizing H1N1 antibodies", Nature, Nature Publishing Group, United Kingdom, vol. 499, No. 7456, Jul. 4, 2013 (Jul. 4, 2013), pp. 102-106.
Thomas Sunil et al: "Vaccines based on structure-based design provide protection against infectious diseases", Expert Review of Vaccines, Expert Reviews Ltd, GB, vol. 12, No. 11, Nov. 1, 2013 (Nov. 1, 2013), pp. 1301-1311.
Florian Krammer et al: Influenza virus hemagglutinin stalk-based antibodies and vaccines, Current Opinion in Virology, vol. 3, No. 5, Oct. 1, 2013 (Oct. 1, 2013), pp. 521-530.
Sagawa H et al: The immunological activity of a deletion mutant of influenza virus haemagglutinin lacking the globular region 11, Journal of General Virology, Society for General Microbiology, Spencers Wood, GB, vol. 77, No. 7, Jan. 1, 1996 (Jan. 1, 1996), pp. 1483-1487.
Madhu Khanna et al: "Protective Immunity Based on the Conserved Hemagglutinin Stalk Domain and Its Prospects for Universal Influenza Vaccine Development", Biomed Research International, vol. 284, No. 13, Jan. 1, 2014 (Jan. 1, 2014), pp. 1655-1657.
J. S. Robertson: "Sequence Analysis of the Haemagglutinin of A/Taiwan/1/86, a New Variant of Human Influenza A(H1N1) Virus", Journal of General Virology, vol. 68, No. 4, 1 Apr. 1, 1987 (Apr. 1, 1987), pp. 1205-1208.

(Continued)

*Primary Examiner* — Agnieszka Boesen
(74) *Attorney, Agent, or Firm* — Sheridan Ross P.C.

(57) ABSTRACT

Vaccines that elicit broadly protective anti-influenza antibodies. Some vaccines comprise nanoparticles that display HA trimers from influenza virus on their surface. The nanoparticles are fusion proteins comprising a monomeric subunit (e.g., ferritin) joined to the stem region of an influenza HA protein. The fusion proteins self-assemble to form the HA-displaying nanoparticles. The vaccines comprise only the stem region of an influenza HA protein joined to a trimerization domain. Also provided are fusion proteins, and nucleic acid molecules encoding such proteins, and assays using nanoparticles of the invention to detect anti-influenza antibodies.

18 Claims, 42 Drawing Sheets

Specification includes a Sequence Listing.

(56) References Cited

OTHER PUBLICATIONS

International Preliminary Report on Patentability for International (PCT) Patent Application No. PCT/US2015/032695, dated Dec. 8, 2016 9 pages.
Official Action for Canada Patent Application No. 2,950,085, dated Oct. 30, 2017 6 pages.
Official Action for European Patent Application No. 15727824.3, dated Dec. 11, 2017 5 pages.
Official Action for European Patent Application No. 15727824.3, dated Jun. 22, 2018 8 pages.

* cited by examiner

| HA stem percentage of immunogen surface | | |
|---|---|---|
| | Gen 4 | Gen6 |
| HA | HS-SS | HS-SS |
| 37% | 71% | 94% | variable ▨▨▨ conserved

Figure 1b

H1-SS-np cryo-EM 2D radial density profile

Gen6 HA-SS specific Ig concentration in blood

- Naive Ig
- H1-SS-np immune Ig y-axis: mg/ml

Gen6_H1NC99_K394M/E446L/E448Q/R449W/D452L/Y437D/N438L_N19Q

Plasmid map: Gen6 H1NC99 rpk3, 5579 bp

Features:
- Kan.
- CMV/R Gen6 H1NC99 rpk3
- CMV IE Enhancer/Promoter
- HTLV-1 R Region/Splicing Donor
- CMV IE Splicing Acceptor
- Gen6 H1NC99 rpk3
- Tbgh Nucleotide of sequence insert        SEQ ID NO: 263

Nucleotide sequence of entire plasmid        SEQ ID NO: 266

Gen6_H1CA09_K394M/E446L/E448Q/R449W/D452L/Y437D/N438L_N19Q

Nucleotide of sequence insert          SEQ ID NO: 270

Nucleotide sequence of entire plasmid          SEQ ID NO:273

Nucleotide of sequence insert      SEQ ID NO: 277

Nucleotide sequence of entire plasmid      SEQ ID NO: 280

Figure 8

Gen6_H5Ind05_K394M/M445L/E446L/E448Q/R449W/D452L/Y437D/N438L/S49bW_N19Q

Plasmid map: Gen6 H5Ind05 rpk3, 5588 bp

Features labeled:
- Kan.
- CMVR Gen6 H5Ind05 rpk3
- CMV IE Enhancer/Promoter
- HTLV-1 R Region/Splicing Donor
- CMV IE Splicing Acceptor
- Gen6 H5Ind05 rpk3
- Tbgh Nucleotide of sequence insert          SEQ ID NO: 284

Nucleotide sequence of entire plasmid          SEQ ID NO: 287

Figure 10

Gen6_H1NC99_K394M/E446L/Y437D/N438L_N19Q

Plasmid map: Gen6 H1NC99 rpk22, 5579 bp

Features:
- CMV/R Gen6 H1NC99 rpk22
- CMV IE Enhancer/Promoter
- HTLV-1 R Region/Splicing Donor
- CMV IE Splicing Acceptor
- Gen6 H1NC99 rpk22
- Tbgh
- Kan.

| | |
|---|---|
| Nucleotide of sequence insert | SEQ ID NO: 298 |
| Nucleotide sequence of entire plasmid | SEQ ID NO: 301 |

Figure 11

Gen6_H1NC99_K394I/E446I/Y437D/N438L_N19Q

Plasmid map: Gen6 H1NC99 rpk22 II, 5579 bp

Features:
- Kan.
- CMV/R Gen6 H1NC99 rpk22 II
- CMV IE Enhancer/Promoter
- HTLV-1 R Region/Splicing Donor
- CMV IE Splicing Acceptor
- Gen6 H1NC99 rpk22 II
- Tbgh

| | |
|---|---|
| Nucleotide of sequence insert | SEQ ID NO: 305 |
| Nucleotide sequence of entire plasmid | SEQ ID NO: 308 |

Figure 12

Gen6_H1NC99_K394L/E446I/Y437D/N438L_N19Q

Plasmid map: Gen6 H1NC99 rpk22 LI, 5579 bp

Features:
- CMV/R Gen6 H1NC99 rpk22 LI
- CMV IE Enhancer/Promoter
- HTLV-1 R Region/Splicing Donor
- CMV IE Splicing Acceptor
- Gen6 H1NC99 rpk22 LI
- Tbgh
- Kan.

Nucleotide of sequence insert        SEQ ID NO: 312

Nucleotide sequence of entire plasmid        SEQ ID NO: 315

Gen6_H1NC99_K394L/E446L/Y437D/N438L_N19Q

Nucleotide of sequence insert     SEQ ID NO: 319

Nucleotide sequence of entire plasmid     SEQ ID NO: 322

Figure 14

Gen6_H1NC99_K394M/E446M/Y437D/N438L_N19Q

Plasmid map: Gen6 H1NC99 rpk22 MM, 5579 bp

Features:
- CMV/R Gen6 H1NC99 rpk22 MM
- CMV IE Enhancer/Promoter
- HTLV-1 R Region/Splicing Donor
- CMV IE Splicing Acceptor
- Gen6 H1NC99 rpk22 MM
- Tbgh
- Kan.

Nucleotide of sequence insert        SEQ ID NO: 326

Nucleotide sequence of entire plasmid    SEQ ID NO: 329

Figure 15

Gen6_H1NC99_K394Q/E446Q/Y437D/N438L_N19Q

Plasmid map: Gen6 H1NC99 rpk22 QQ, 5579 bp

Features:
- Kan.
- CMV/R Gen6 H1NC99 rpk22 QQ
- CMV IE Enhancer/Promoter
- HTLV-1 R Region/Splicing Donor
- CMV IE Splicing Acceptor
- Gen6 H1NC99 rpk22 QQ
- Tbgh Nucleotide of sequence insert          SEQ ID NO: 333

Nucleotide sequence of entire plasmid          SEQ ID NO: 336

Figure 16

Gen6_H1NC99_K394M/E446L/Y437D/N438L/H45N/V47T_N19Q

Plasmid map of Gen6 H1NC99 rpk22 gly4, 5579 bp, with features:
- CMV/R Gen6 H1NC99 rpk22 gly4
- CMV IE Enhancer/Promoter
- HTLV-1 R Region/Splicing Donor
- CMV IE Splicing Acceptor
- Gen6 H1NC99 rpk22 gly4
- Tbgh
- Kan.

| | |
|---|---|
| Nucleotide of sequence insert | SEQ ID NO: 340 |
| Nucleotide sequence of entire plasmid | SEQ ID NO: 343 |

Nucleotide of sequence insert     SEQ ID NO: 347

Nucleotide sequence of entire plasmid     SEQ ID NO: 350

Figure 18

Gen6_H1NC99_K394M/E446L/E448Q/R449W/D452L/S402aN/G402cT/S402dG/T402fA/Y437D/N438L_N19Q

[Plasmid map: Gen6 H1NC99 rpk3 gly1, 5579 bp, showing Kan., CMV/R Gen6 H1NC99 rpk3 gly1, CMV IE Enhancer/Promoter, HTLV-1 R Region/Splicing Donor, CMV IE Splicing Acceptor, Gen6 H1NC99 rpk3 gly1, Tbgh]

Nucleotide of sequence insert          SEQ ID NO: 354

Nucleotide sequence of entire plasmid          SEQ ID NO: 357

Figure 19

Gen6_H1NC99_K394M/E446L/E448Q/R449W/D452L/S402bG/G402cN/S402eT/T402fA/Y437D/N438L_N19Q

Plasmid map: Gen6 H1NC99 rpk3 gly2, 5579 bp

Features labeled:
- Kan.
- CMV/R Gen6 H1NC99 rpk3 gly2
- CMV IE Enhancer/Promoter
- HTLV-1 R Region/Splicing Donor
- CMV IE Splicing Acceptor
- Gen6 H1NC99 rpk3 gly2
- Tbgh

| | |
|---|---|
| Nucleotide of sequence insert | SEQ ID NO: 361 |
| Nucleotide sequence of entire plasmid | SEQ ID NO: 364 |

Figure 20

Gen6_H1NC99_K394M/E446L/E448Q/R449W/D452L/S402eN/Y437D/N438L_N19Q

[Plasmid map: Gen6 H1NC99 rpk3 gly3, 5579 bp, with labeled features: Kan., CMV/R Gen6 H1NC99 rpk3 gly3, CMV IE Enhancer/Promoter, HTLV-1 R Region/Splicing Donor, CMV IE Splicing Acceptor, Gen6 H1NC99 rpk3 gly3, Tbgh]

Nucleotide of sequence insert       SEQ ID NO: 368

Nucleotide sequence of entire plasmid       SEQ ID NO: 371

Figure 21

Gen6_H1NC99_K394M/E446L/E448Q/R449W/D452L/G402cN/G402eT/T402fA/Q370N/E372T/Y437D/N438L_S21T

Plasmid map: Gen6 H1NC99 rpk3 gly2-6-7, 5579 bp

Features:
- CMV/R Gen6 H1NC99 rpk3 gly2-6-7
- CMV IE Enhancer/Promoter
- HTLV-1 R Region/Splicing Donor
- CMV IE Splicing Acceptor
- Gen6 H1NC99 rpk3 gly2-6-7
- Tbgh
- Kan.

Nucleotide of sequence insert      SEQ ID NO: 375

Nucleotide sequence of entire plasmid      SEQ ID NO: 378

Figure 22

Gen6_H1NC99_K394M/E446L/E448Q/R449W/D452L/G402cN/G402eT/T402fA/Q370N/E372T/Y437D/N438L_S21T/Q69N

[Plasmid map: Gen6 H1NC99 rpk3 gly2-5-6-7, 5579 bp, showing Kan., CMV/R Gen6 H1NC99 rpk3 gly2-5-6-7, CMV IE Enhancer/Promoter, HTLV-1 R Region/Splicing Donor, CMV IE Splicing Acceptor, Gen6 H1NC99 rpk3 gly2-5-6-7, Tbgh]

Nucleotide of sequence insert      SEQ ID NO: 382

Nucleotide sequence of entire plasmid      SEQ ID NO: 385

| Nucleotide of sequence insert | SEQ ID NO: 389 |
| Nucleotide sequence of entire plasmid | SEQ ID NO: 392 |

Nucleotide sequence of insert      SEQ ID NO: 396

Nucleotide sequence of entire plasmid      SEQ ID NO: 399

STABILIZED INFLUENZA HEMAGGLUTININ STEM REGION TRIMERS AND USES THEREOF

CROSS REFERENCE TO RELATED APPLICATIONS

This application is a national stage application under 35 U.S.C. 371 and claims the benefit of PCT Application No. PCT/US2015/032695 having an international filing date of 27 May 2015, which designated the United States, which PCT application claimed the benefit of U.S. Provisional Application No. 62/003,471 filed 27 May 2014. Each of these disclosures are incorporated herein by reference.

REFERENCE TO SEQUENCE LISTING

This application contains a Sequence Listing submitted as an electronic text file named "6137NIAID-36-PCT_Sequence_Listing_ST25.txt", having a size in bytes of 8835 KB, and created on May 27, 2015. The information contained in this electronic file is hereby incorporated by reference in its entirety pursuant to 37 CFR § 1.52(e)(5).

SUMMARY OF THE INVENTION

The present invention provides novel hemagglutinin (HA) protein-based influenza vaccines that are easily manufactured, potent, and which elicit broadly neutralizing influenza antibodies against the stem region of the influenza HA protein. In particular, the present invention provides modified influenza HA stem-region proteins in the pre-fusion conformation, and portions thereof, that are useful for inducing the production of neutralizing antibodies. The present invention also provides novel nanoparticle (np)-based vaccines that express the influenza HA protein on their surface. Such nanoparticles comprise fusion proteins, each of which comprises a monomeric subunit of ferritin joined to an antigenic or immunogenic portion of the stem region from an influenza HA protein. Because such nanoparticles display influenza HA protein stem regions on their surface, they can be used to vaccinate an individual against influenza virus.

BACKGROUND

Protective immune responses induced by vaccination against influenza viruses are primarily directed to the viral HA protein, which is a glycoprotein on the surface of the virus responsible for interaction of the virus with host cell receptors. HA proteins on the virus surface are trimers of HA protein monomers that are enzymatically cleaved to yield amino-terminal HA1 and carboxy-terminal HA2 polypeptides. The globular head consists exclusively of the major portion of the HA1 polypeptide, whereas the stem that anchors the HA protein into the viral lipid envelope is comprised of HA2 and part of HA1. The globular head of a HA protein includes two domains: the receptor binding domain (RBD), an ~148-amino acid residue domain that includes the sialic acid-binding site, and the vestigial esterase domain, a smaller ~75-amino acid residue region just below the RBD. The globular head includes several antigenic sites that include immunodominant epitopes. Examples include the Sa, Sb, $Ca_1$, $Ca_2$ and Cb antigenic sites (see, for example, Caton A J et al, 1982, Cell 31, 417-427). The RBD-A region includes the Sa antigenic site and part of the Sb antigenic site.

Antibodies against influenza often target variable antigenic sites in the globular head of HA, which surround a conserved sialic acid binding site, and thus, neutralize only antigenically closely related viruses. The variability of the HA head is due to the constant antigenic drift of influenza viruses and is responsible for seasonal endemics of influenza. In contrast, the HA stem is highly conserved and experiences little antigenic drift. Unfortunately, unlike the immunodominant head, the conserved HA stem is not very immunogenic. Furthermore, gene segments of the viral genome can undergo reassortment (antigenic shift) in host species, creating new viruses with altered antigenicity that are capable of becoming pandemics [Salomon, R. et al. *Cell* 136, 402-410 (2009)]. Until now, each year, influenza vaccine is updated to reflect the predicted HA and neuraminidase (NA) for upcoming circulating viruses.

Recently, an entirely new class of broadly neutralizing antibodies against influenza viruses was isolated that recognize the highly conserved HA stem [Corti, D. et al. *J Clin Invest* 120, 1663-1673 (2010); Ekiert, D. C. et al. *Science* 324, 246-251 (2009); Kashyap, A. K. et al. *Proc Natl Acad Sci USA* 105, 5986-5991 (2008); Okuno, Y. et al. *J Virol* 67, 2552-2558 (1993); Sui, J. et al. *Nat Struct Mol Biol* 16, 265-273 (2009); Ekiert, D. C. et al. *Science* 333, 843-850 (2011); Corti, D. et al. *Science* 333, 850-856 (2011)]. Unlike strain-specific antibodies, those antibodies are capable of neutralizing multiple antigenically distinct viruses, and hence inducing such antibodies has been a focus of next generation universal vaccine development [Nabel, G. J. et al. *Nat Med* 16, 1389-1391 (2010)]. However, robustly eliciting these antibodies with such heterologous neutralizing profile by vaccination has been difficult [Steel, J. et al. *MBio* 1, e0018 (2010); Wang, T. T. et al. *PLoS Pathog* 6, e1000796 (2010); Wei, C. J. et al. *Science* 329, 1060-1064 (2010)]. Removal of the immunodominant head region of HA (which contains competing epitopes) and stabilization of the resulting stem domain through genetic manipulation is one potential way to improve the elicitation of these broadly neutralizing stem antibodies.

Current vaccine strategies for influenza use either a chemically inactivated or a live attenuated influenza virus. Both vaccines are generally produced in embryonated eggs which present major manufacturing limitations due to the time consuming process and limited production capacity. Another more critical limitation of current vaccines is its highly strain-specific efficacy. These challenges became glaring obvious during emergence of the 2009 H1N1 pandemic, thus validating the necessity for new vaccine platforms capable of overcoming these limitations. Virus-like particles represent one of such alternative approaches and are currently being evaluated in clinical trials [Roldao, A. et al. *Expert Rev Vaccines* 9, 1149-1176 (2010); Sheridan, C. *Nat Biotechnol* 27, 489-491 (2009)]. Instead of embryonated eggs, VLPs that often comprise HA, NA and matrix protein 1 (M1) can be mass-produced in mammalian or insect cell expression systems [Haynes, J. R. *Expert Rev Vaccines* 8, 435-445 (2009)]. The advantages of this approach are its particulate, multivalent nature and the authentic display of properly folded, trimeric HA spikes that faithfully mimic the infectious virion. In contrast, by the nature of its assembly, the enveloped VLPs contain a small but finite host cell component that may present potential safety, immunogenicity challenges following repeated use of this platform [Wu, C. Y. et al. *PLoS One* 5, e9784 (2010)]. Moreover, the immunity induced by the VLPs is essentially the same as current vaccines, and thus, will not likely significantly improve both potency and breadth of vaccine-induced protective immunity. In addition to VLPs, a recombinant HA protein has also been evaluated in humans [Treanor, J. J. et al. *Vaccine* 19, 1732-1737 (2001); Treanor, J. J. *JAMA* 297, 1577-1582 (2007)], though the ability to induce protective neutralizing antibody titers are limited. The recombinant HA proteins used in those trials were produced in insect cells and might not form native trimer preferentially [Stevens, J. *Science* 303, 1866-1870 (2004)].

Despite several alternatives to conventional influenza vaccines, advances in biotechnology in past decades have allowed engineering of biological materials to be exploited for the generation of novel vaccine platforms. Ferritin, an iron storage protein found in almost all living organisms, is an example which has been extensively studied and engineered for a number of potential biochemical/biomedical purposes [Iwahori, K. U.S. Patent 2009/0233377 (2009); Meldrum, F. C. et al. *Science* 257, 522-523 (1992); Naitou, M. et al. U.S. Patent 2011/0038025 (2011); Yamashita, I. *Biochim Biophys Acta* 1800, 846-857 (2010)], including a potential vaccine platform for displaying exogenous epitope peptides [Carter, D. C. et al. U.S. Patent 2006/0251679 (2006); Li, C. Q. et al. *Industrial Biotechnol* 2, 143-147 (2006)]. Its use as a vaccine platform is particularly interesting because of its self-assembly and multivalent presentation of antigen which induces stronger B cell responses than monovalent form as well as induce T-cell independent antibody responses [Bachmann, M. F. et al. *Annu Rev Immunol* 15, 235-270 (1997); Dintzis, H. M. et al. *Proc Natl Acad Sci USA* 73, 3671-3675 (1976)]. Further, the molecular architecture of ferritin, which consists of 24 subunits assembling into an octahedral cage with 432 symmetry has the potential to display multimeric antigens on its surface.

There remains a need for an efficacious influenza vaccine that provides robust protection against influenza virus. There particularly remains a need for an influenza vaccine that protects individuals from heterologous strains of influenza virus, including evolving seasonal and pandemic influenza virus strains of the future. The present invention meets this need by providing a novel nanoparticle-based vaccine consisting of a novel HA stabilized stem (SS) without the variable immunodominant head region genetically fused to the surface of nanoparticles (gen6 HA-SS np) resulting in an influenza vaccine that is easily manufactured, potent, and elicits antibodies that are broadly heterosubtypic protective.

BRIEF DESCRIPTION OF THE FIGURES

FIG. 1b shows the surface representations of the HA portions of H1N1 HA ectodomain (PDB ID 1GBN), Gen4 HA-SS and Gen6 HA-SS respectively without the foldon domains, shaded by sequence conservation with H5N1 2004 VN (dark gray, variable; white, conserved). The HA stem percentage of the immunogens without foldon domains increase for Gen4 and Gen6 HA-SS respectively. *This immunogen was evaluated further and is referred to as H1-SS-np in the Examples section of this disclosure.

Figure 1A:
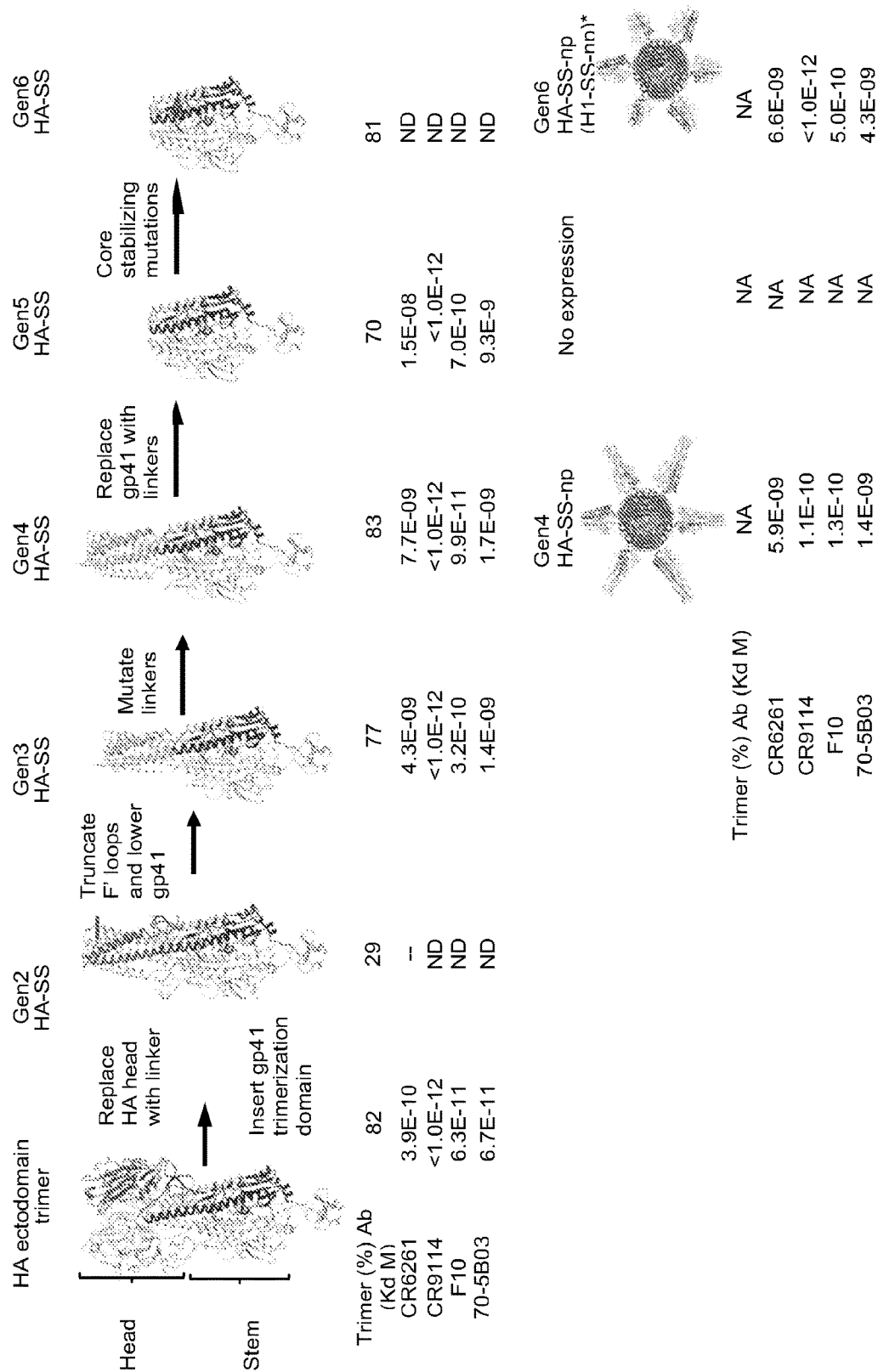
FIG. 1a shows the structure-based removal of the HA head allows for preservation of stem immunogen antigenicity. The ribbon models depict the HA-SS design pathway starting with the model of an HA ectodomain fused to a T4 foldon trimerization domain (in green below HA ectodomain). The last three HA-SS designs (Gen4-6) were genetically fused to ferritin nanoparticles (lower panel). One monomer of each HA trimer is shaded. The core stabilizing mutations for creating Gen6 are shown as spheres. The percent trimerization (including foldon) and antigenic affinity constants ($K_D$, M) to specified mAbs are shown below each HA-SS immunogen design. ND, not determined; NA, not applicable.

In addition to the above, unless specifically defined otherwise, the following terms and phrases, which are common to the various embodiments disclosed herein, are defined as follows:

As used herein, a protein construct is a protein made by the hand of man, in which two or more amino acid sequences have been covalently joined in a way not found in nature. The amino acid sequences being joined can be related or unrelated. As used herein, polypeptide sequences are unrelated, if their amino acid sequences are not normally found joined together via a covalent bond in their natural environment(s) (e.g., inside a cell). For example, the amino acid sequences of monomeric subunits that make up ferritin, and the amino acid sequences of influenza HA proteins are not normally found joined together via a covalent bond. Thus, such sequences are considered unrelated.

Protein constructs can also comprise related amino acid sequences. For example, the structure of the influenza HA protein is such that the head region amino acid sequence is flanked on both ends by stem region amino acid sequences. Through genetic means, it is possible to create a deletion version of an HA protein by removing amino acid residues from the middle of the head region, while maintaining a portion of the head region flanked by stem regions sequences. While the order of the sequences in the final molecule would remain the same, the spatial relationship between the amino acids would differ from the natural protein. Thus, such a molecule would be considered a protein construct. According to the present invention, protein constructs may also be referred to as fusion proteins.

Amino acid sequences in a protein construct can be joined directly to each other or they can be joined using a linker sequence. A linker sequence, peptide, or polypeptide, is a short (e.g., 2-20) amino acid sequence used to connect two proteins having a desired characteristic (e.g., structure, epitope, immunogenicity, activity, etc.). A linker sequence typically does not have its own activity and is usually used to allow other parts of the protein construct to assume a desired conformation. Linker sequences are typically made from small amino acid residues and/or runs thereof, such as, for examples, serine, alanine and glycine, although the use of other amino acid residues is not excluded.

As used herein, the term immunogenic refers to the ability of a specific protein, or a specific region thereof, to elicit an immune response to the specific protein, or to proteins comprising an amino acid sequence having a high degree of identity with the specific protein. According to the present invention, two proteins having a high degree of identity have amino acid sequences at least 80% identical, at least 85% identical, at least 87% identical, at least 90% identical, at least 92% identical, at least 93% identical, at least 94% identical, at least 95% identical, at least 96% identical, at least 97% identical, at least 98% identical or at least 99% identical. Methods of determining the percent identity between two amino acid or nucleic acid sequence are known in the art.

As used herein, an immune response to a vaccine, or nanoparticle, of the present invention is the development in a subject of a humoral and/or a cellular immune response to a HA protein present in the vaccine. For purposes of the present invention, a "humoral immune response" refers to an immune response mediated by antibody molecules, including secretory (IgA) or IgG molecules, while a "cellular immune response" is one mediated by T-lymphocytes and/or other white blood cells. One important aspect of cellular immunity involves an antigen-specific response by cytolytic T-cells ("CTL"s). CTLs have specificity for peptide antigens that are presented in association with proteins encoded by the major histocompatibility complex (MHC) and expressed on the surfaces of cells. CTLs help induce and promote the destruction of intracellular microbes, or the lysis of cells infected with such microbes. Another aspect of cellular immunity involves an antigen-specific response by helper T-cells. Helper T-cells act to help stimulate the function, and focus the activity of, nonspecific effector cells against cells displaying peptide antigens in association with MHC molecules on their surface. A cellular immune response also refers to the production of cytokines, chemokines and other such molecules produced by activated T-cells and/or other white blood cells, including those derived from CD4+ and CD8+T-cells.

Thus, an immunological response may be one that stimulates CTLs, and/or the production or activation of helper T-cells. The production of chemokines and/or cytokines may also be stimulated. The vaccine may also elicit an antibody-mediated immune response. Hence, an immunological response may include one or more of the following effects: the production of antibodies (e.g., IgA or IgG) by B-cells; and/or the activation of suppressor, cytotoxic, or helper T-cells and/or T-cells directed specifically to an HA protein present in the vaccine. These responses may serve to neutralize infectivity (e.g., antibody-dependent protection), and/or mediate antibody-complement, or antibody dependent cell cytotoxicity (ADCC) to provide protection to an immunized individual. Such responses can be determined using standard immunoassays and neutralization assays, well known in the art.

As used herein, the term antigenic, antigenicity, and the like, refers to a protein that is bound by an antibody or a group of antibodies. Similarly, an antigenic portion of a protein is any portion that is recognized by an antibody or a group of antibodies. According to the present invention, recognition of a protein by an antibody means the antibody selectively binds to the protein. As used herein, the phrase selectively binds, selective binding, and the like, refer to the ability of an antibody to preferentially bind an HA protein as opposed to binding proteins unrelated to HA, or non-protein components in the sample or assay. An antibody that preferentially binds HA is one that binds HA but does not significantly bind other molecules or components that may be present in the sample or assay. Significant binding is considered, for example, binding of an anti-HA antibody to a non-HA molecule with an affinity or avidity great enough to interfere with the ability of the assay to detect and/or determine the level of anti-influenza antibodies, or HA protein, in the sample. Examples of other molecules and compounds that may be present in the sample, or the assay, include, but are not limited to, non-HA proteins, such as albumin, lipids and carbohydrates. According to the present invention, a non-HA protein is a protein having an amino acid sequence sharing less than 60% identity with the sequence of an influenza HA protein disclosed herein. In some embodiments, the antibody or antibodies provide broad heterosubtypic protection. In some embodiments, the antibody or antibodies are neutralizing.

As used herein, neutralizing antibodies are antibodies that prevent influenza virus from completing one round of replication. As defined herein, one round of replication refers the life cycle of the virus, starting with attachment of the virus to a host cell and ending with budding of newly formed virus from the host cell. This life cycle includes, but is not limited to, the steps of attaching to a cell, entering a cell, cleavage and rearrangement of the HA protein, fusion of the viral membrane with the endosomal membrane, release of viral ribonucleoproteins into the cytoplasm, formation of new viral particles and budding of viral particles from the host cell membrane. According to the present invention, a neutralizing antibody is one that inhibits one or more such steps.

As used herein, broadly neutralizing antibodies are antibodies that neutralize more than one type, subtype and/or strain of influenza virus. For example, broadly neutralizing antibodies elicited against an HA protein from a Type A influenza virus may neutralize a Type B or Type C virus. As a further example, broadly neutralizing antibodies elicited against an HA protein from Group I influenza virus may neutralize a Group 2 virus. As an additional example, broadly neutralizing antibodies elicited against an HA protein from one sub-type or strain of virus, may neutralize another sub-type or strain of virus. For example, broadly neutralizing antibodies elicited against an HA protein from an H1 influenza virus may neutralize viruses from one or more sub-types selected from the group consisting of H2, H3, H4, H5, H6, H7, H8, H8, H10, H11, H12, H13, H14, H15, H16, H17 or H18.

According to the present invention all nomenclature used to classify influenza virus is that commonly used by those skilled in the art. Thus, a Type, or Group, of influenza virus refers to influenza Type A, influenza Type B or influenza type C. It is understood by those skilled in the art that the designation of a virus as a specific Type relates to sequence difference in the respective M1 (matrix) protein or NP (nucleoprotein). Type A influenza viruses are further divided into Group1 and Group 2. These Groups are further divided into subtypes, which refers to classification of a virus based on the sequence of its HA protein. Examples of current commonly recognized subtypes are H1, H2, H3, H4, H5, H6, H7, H8, H8, H10, H11, H12, H13, H14, H15, H16, H17 or H18. Group 1 influenza subtypes are H1, H2, H5, H6, H8, H9, H11, H12, H13, H16, H17 and H18. Group 2 influenza subtypes are H3, H4, H7, H10, H14, and H15. Finally, the term strain refers to viruses within a subtype that differ from one another in that they have small, genetic variations in their genome.

As used herein, an influenza hemagglutinin protein, or HA protein, refers to a full-length influenza hemagglutinin protein or any portion thereof, that is useful for producing protein constructs and nanoparticles of the invention or that are capable of eliciting an immune response. Preferred HA proteins are those that are capable of forming a trimer. An epitope of a full-length influenza HA protein refers to a portion of such protein that can elicit an antibody response against the homologous influenza strain, i.e., a strain from which the HA is derived. In some embodiments, such an epitope can also elicit an antibody response against a heterologous influenza strain, i.e., a strain having an HA that is not identical to that of the HA of the immunogen. In some embodiments, the epitope elicits a broadly heterosubtypic protective response. In some embodiments, the epitope elicits neutralizing antibodies.

As used herein, a variant refers to a protein, or nucleic acid molecule, the sequence of which is similar, but not identical to, a reference sequence, wherein the activity of the variant protein (or the protein encoded by the variant nucleic acid molecule) is not significantly altered. These variations in sequence can be naturally occurring variations or they can be engineered through the use of genetic engineering technique know to those skilled in the art. Examples of such techniques are found in Sambrook J, Fritsch E F, Maniatis T et al., in Molecular Cloning—A Laboratory Manual, 2nd Edition, Cold Spring Harbor Laboratory Press, 1989, pp. 9.31-9.57), or in Current Protocols in Molecular Biology, John Wiley & Sons, N.Y. (1989), 6.3.1-6.3.6, both of which are incorporated herein by reference in their entirety.

With regard to variants, any type of alteration in the amino acid, or nucleic acid, sequence is permissible so long as the resulting variant protein retains the ability to elicit neutralizing or non-neutralizing antibodies against an influenza virus. Examples of such variations include, but are not limited to, deletions, insertions, substitutions and combinations thereof. For example, with regard to proteins, it is well understood by those skilled in the art that one or more (e.g., 2, 3, 4, 5, 6, 7, 8, 9 or 10), amino acids can often be removed from the amino and/or carboxy terminal ends of a protein without significantly affecting the activity of that protein. Similarly, one or more (e.g., 2, 3, 4, 5, 6, 7, 8, 9 or 10) amino acids can often be inserted into a protein without significantly affecting the activity of the protein. In variants into which insertions have been made, the inserted amino acids may be referred to by referencing the amino acid residue after which the insertion was made. For example, an insertion of four amino acid residues after amino acid residue 402 could be referred to as 402a-402d. Moreover, if one of those inserted amino acids are later substituted with another amino acid, such a change can be referred to by reference to the letter position. For example, substitution of an inserted glycine (in the further position of the insert) with a threonine can be referred to as S402dT.

As noted, variant proteins of the present invention can contain amino acid substitutions relative to the influenza HA proteins disclosed herein. Any amino acid substitution is permissible so long as the activity of the protein is not significantly affected. In this regard, it is appreciated in the art that amino acids can be classified into groups based on their physical properties. Examples of such groups include, but are not limited to, charged amino acids, uncharged amino acids, polar uncharged amino acids, and hydrophobic amino acids. Preferred variants that contain substitutions are those in which an amino acid is substituted with an amino acid from the same group. Such substitutions are referred to as conservative substitutions.

Naturally occurring residues may be divided into classes based on common side chain properties:
  1) hydrophobic: Met, Ala, Val, Leu, Ile;
  2) neutral hydrophilic: Cys, Ser, Thr;
  3) acidic: Asp, Glu;
  4) basic: Asn, Gln, His, Lys, Arg;
  5) residues that influence chain orientation: Gly, Pro; and
  6) aromatic: Trp, Tyr, Phe.

For example, non-conservative substitutions may involve the exchange of a member of one of these classes for a member from another class.

In making amino acid changes, the hydropathic index of amino acids may be considered. Each amino acid has been assigned a hydropathic index on the basis of its hydrophobicity and charge characteristics. The hydropathic indices are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5). The importance of the hydropathic amino acid index in conferring interactive biological function on a protein is generally understood in the art (Kyte et al., 1982, J. Mol. Biol. 157:105-31). It is known that certain amino acids may be substituted for other amino acids having a similar hydropathic index or score and still retain a similar biological activity. In making changes based upon the hydropathic index, the substitution of amino acids whose hydropathic indices are within ±2 is preferred, those within ±1 are particularly preferred, and those within ±0.5 are even more particularly preferred.

It is also understood in the art that the substitution of like amino acids can be made effectively on the basis of hydrophilicity, particularly where the biologically functionally equivalent protein or peptide thereby created is intended for use in immunological invention, as in the present case. The greatest local average hydrophilicity of a protein, as governed by the hydrophilicity of its adjacent amino acids, correlates with its immunogenicity and antigenicity, i.e., with a biological property of the protein. The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); and tryptophan (−3.4). In making changes based upon similar hydrophilicity values, the substitution of amino acids whose hydrophilicity values are within ±2 is preferred, those within ±1 are particularly preferred, and those within ±0.5 are even more particularly preferred. One may also identify epitopes from primary amino acid sequences on the basis of hydrophilicity.

Desired amino acid substitutions (whether conservative or non-conservative) can be determined by those skilled in the art at the time such substitutions are desired. For example, amino acid substitutions can be used to identify important residues of the HA protein, or to increase or decrease the immunogenicity, solubility or stability of the HA proteins described herein. Exemplary amino acid substitutions are shown below in Table 1.

TABLE 1

| Amino Acid Substitutions | |
|---|---|
| Original Amino Acid | Exemplary Substitutions |
| Ala | Val, Leu, Ile |
| Arg | Lys, Gln, Asn |
| Asn | Gln |
| Asp | Glu |
| Cys | Ser, Ala |
| Gln | Asn |
| Glu | Asp |
| Gly | Pro, Ala |
| His | Asn, Gln, Lys, Arg |
| Ile | Leu, Val, Met, Ala |
| Leu | Ile, Val, Met, Ala |
| Lys | Arg, Gln, Asn |

TABLE 1-continued

| Amino Acid Substitutions | |
|---|---|
| Original Amino Acid | Exemplary Substitutions |
| Met | Leu, Phe, Ile |
| Phe | Leu, Val, Ile, Ala, Tyr |
| Pro | Ala |
| Ser | Thr, Ala, Cys |
| Thr | Ser |
| Trp | Tyr, Phe |
| Tyr | Trp, Phe, Thr, Ser |
| Val | Ile, Met, Leu, Phe, Ala |

As used herein, the phrase significantly affect a proteins activity refers to a decrease in the activity of a protein by at least 10%, at least 20%, at least 30%, at least 40% or at least 50%. With regard to the present invention, such an activity may be measured, for example, as the ability of a protein to elicit protective antibodies against an influenza virus. Such activity may be measured by measuring the titer of such antibodies against influenza virus, the ability of such antibodies to protect against influenza infection or by measuring the number of types, subtypes or strains neutralized by the elicited antibodies. Methods of determining antibody titers, performing protection assays and performing virus neutralization assays are known to those skilled in the art. In addition to the activities described above, other activities that may be measured include the ability to agglutinate red blood cells and the binding affinity of the protein for a cell. Methods of measuring such activities are known to those skilled in the art.

The terms individual, subject, and patient are well-recognized in the art, and are herein used interchangeably to refer to any human or other animal susceptible to influenza infection. Examples include, but are not limited to, humans and other primates, including non-human primates such as chimpanzees and other apes and monkey species; farm animals such as cattle, sheep, pigs, seals, goats and horses; domestic mammals such as dogs and cats; laboratory animals including rodents such as mice, rats and guinea pigs; birds, including domestic, wild and game birds such as chickens, turkeys and other gallinaceous birds, ducks, geese, and the like. The terms individual, subject, and patient by themselves, do not denote a particular age, sex, race, and the like. Thus, individuals of any age, whether male or female, are intended to be covered by the present disclosure and include, but are not limited to the elderly, adults, children, babies, infants, and toddlers. Likewise, the methods of the present invention can be applied to any race, including, for example, Caucasian (white), African-American (black), Native American, Native Hawaiian, Hispanic, Latino, Asian, and European. An infected subject is a subject that is known to have influenza virus in their body.

As used herein, a vaccinated subject is a subject that has been administered a vaccine that is intended to provide a protective effect against an influenza virus.

As used herein, the terms exposed, exposure, and the like, indicate the subject has come in contact with a person of animal that is known to be infected with an influenza virus.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates, which may need to be independently confirmed.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments are specifically embraced by the present invention and are disclosed herein just as if each and every combination was individually and explicitly disclosed. In addition, all sub-combinations are also specifically embraced by the present invention and are disclosed herein just as if each and every such sub-combination was individually and explicitly disclosed herein.

One embodiment of the present invention is a protein construct comprising an influenza HA protein wherein the head region of the influenza HA protein has been replaced with an amino acid sequence comprising less than 5 contiguous amino acid residues from the head region of the HA protein. As used herein, an HA protein, refers to a full-length influenza HA protein or any portion/portions and/or variants thereof, that is/are useful for producing protein constructs and nanoparticles of the invention. Accordingly, the present invention is drawn to molecules that are capable of eliciting an immune response to the stem region of influenza HA protein. In some embodiments, the sequence of the HA protein construct has been further altered (i.e., mutated) to stabilize the stem region of the protein in a form that can be presented to the immune system. Some representative examples of such HA proteins, and protein constructs made there from, are shown in Table 2 below.

TABLE 2

| PCT SEQ ID NO | Comments |
|---|---|
| | FERRITIN |
| 1 | Coding sequence for ferritin monomeric subunit protein from *H. pylori* |
| 2 | Amino acid sequence encoded by SEQ ID NO: 1 |
| 3 | Complement of SEQ ID NO1 |
| 4 | Nucleic acid sequence encoding amino acids 5-167 from SEQ ID NO: 2; Asn19 has been replaced with Gln |
| 5 | Amino acid sequence encoded by SEQ ID NO: 3 |
| 6 | Complement of SEQ ID NO3 |
| | FULL LENGTH HA |
| 7 | Nucleic acid sequence encoding full length hemagglutinin protein from A/New Caledonia/20/1999 (1999 NC, H1)(GenBank: AY289929) |
| 8 | Amino acid sequence encoded by SEQ ID NO: 7 (full length hemagglutinin protein from A/New Caledonia/20/1999 (1999 NC, H1)(GenBank: AY289929)) |
| 9 | Complement of SEQ ID NO: 7 |
| 10 | Nucleic acid sequence encoding full length hemagglutinin protein from A/California/4/2009 (H1) |
| 11 | Amino acid sequence encoded by SEQ ID NO: 10 |
| 12 | Complement of SEQ ID NO: 10 |
| 13 | Nucleic acid sequence encoding full length hemagglutinin protein from A/Singapore/1957 (H2) |
| 14 | Amino acid sequence encoded by SEQ ID NO: 13 |
| 15 | Complement of SEQ ID NO: 13 |
| 16 | Nucleic acid sequence encoding full length hemagglutinin protein from A/Indonesia/05/2005 (H5) |
| 17 | Amino acid sequence encoded by SEQ ID NO: 16 |
| 18 | Complement of SEQ ID NO: 16 |
| | STEM REGION FLANKS |
| 19 | Nucleic acid sequence encoding SEQ ID NO: 20 |
| 20 | Amino acid sequence flanking amino end of head region from H1 NC 1999 |
| 21 | Complement of SEQ ID NO: 19 |
| 22 | Nucleic acid sequence encoding SEQ ID NO: 24 |
| 23 | Amino acid sequence flanking carboxyl end of head region from H1 NC 1999. Contains internal loop region. Long version |
| 24 | Complement of SEQ ID NO: 22 |
| 25 | Nucleic acid sequence encoding SEQ ID NO: 27 |
| 26 | Amino acid sequence flanking carboxyl end of head region from H1 NC 1999. Internal loop region replaced with Ser-Gly loop. Long version |
| 27 | Complement of SEQ ID NO: 25 |
| 28 | Nucleic acid sequence encoding SEQ ID NO: 30 |
| 29 | Amino acid sequence flanking carboxyl end of head region from H1 NC 1999. Contains internal loop region. short version |
| 30 | Complement of SEQ ID NO: 28 |
| 31 | Nucleic acid sequence SEQ ID NO: 33 |
| 32 | Amino acid sequence flanking carboxyl end of head region from H1 NC 1999. Internal loop region replaced with Ser-Gly loop. short version |
| 33 | Complement of SEQ ID NO: 31 |
| 34 | Nucleic acid sequence encoding SEQ ID NO: 35 |

TABLE 2-continued

| PCT SEQ ID NO | Comments |
|---|---|
| 35 | Amino acid sequence flanking amino end of head region from H1 CA 2009 |
| 36 | Complement of SEQ ID NO: 34 |
| 37 | Nucleic acid sequence encoding SEQ ID NO: 38 |
| 38 | Amino acid sequence flanking carboxyl end of head region from H1 CA (2009). Contains internal loop region. Long version |
| 39 | Complement of SEQ ID NO: 37 |
| 40 | Nucleic acid sequence encoding SEQ ID NO: 31 |
| 41 | Amino acid sequence flanking carboxyl end of head region from H1 CA (2009). Internal loop region replaced with Ser-Gly loop. Long version |
| 42 | Complement of SEQ ID NO: 40 |
| 43 | Nucleic acid sequence encoding SEQ ID NO: 44 |
| 44 | Amino acid sequence flanking carboxyl end of head region from H1 CA (2009). Contains internal loop region. short version |
| 45 | Complement of SEQ ID NO: 43 |
| 46 | Nucleic acid sequence encoding SEQ ID NO: 47 |
| 47 | Amino acid sequence flanking carboxyl end of head region from H1 CA (2009). Internal loop region replaced with Ser-Gly loop. Short version |
| 48 | Complement of SEQ ID NO: 46 |
| 49 | Nucleic acid sequence encoding SEQ ID NO: 50 |
| 50 | Amino acid sequence flanking amino end of head region from H2 Sing 1957 |
| 51 | Complement of SEQ ID NO: 49 |
| 52 | Nucleic acid sequence encoding SEQ ID NO: 53 |
| 53 | Amino acid sequence flanking carboxyl end of head region from H2 Sing (1957) Contains internal loop region. Long version |
| 54 | Complement of SEQ ID NO: 52 |
| 55 | Nucleic acid sequence encoding SEQ ID NO: 56 |
| 56 | Amino acid sequence flanking carboxyl end of head region from H2 Sing (1957). Internal loop region replaced with Ser-Gly loop. Long version |
| 57 | Complement of SEQ ID NO: 55 |
| 58 | Nucleic acid sequence encoding SEQ ID NO: 59 |
| 59 | Amino acid sequence flanking carboxyl end of head region from H2 Sing (1957) Contains internal loop region. short version |
| 60 | Complement of SEQ ID NO: 58 |
| 61 | Nucleic acid sequence encoding SEQ ID NO: 62 |
| 62 | Amino acid sequence flanking carboxyl end of head region from H2 Sing (1957). Internal loop region replaced with Ser-Gly loop. short version |
| 63 | Complement of SEQ ID NO: 61 |
| 64 | Nucleic acid sequence encoding SEQ ID NO: 65 |
| 65 | Amino acid sequence flanking amino end of head region from H5 Indo (2005) |
| 66 | Complement of SEQ ID NO: 64 |
| 67 | Nucleic acid sequence encoding SEQ ID NO: 68 |
| 68 | Amino acid sequence flanking carboxyl end of head region from H5 Indo (2005) Contains internal loop region. Long version |
| 69 | Complement of SEQ ID NO: 67 |
| 70 | Nucleic acid sequence encoding SEQ ID NO: 71 |
| 71 | Amino acid sequence flanking carboxyl end of head region from H5 Indo (2005). Internal loop region replaced with Ser-Gly loop. Long version |
| 72 | Complement of SEQ ID NO: 70 |
| 73 | Nucleic acid sequence encoding SEQ ID NO: 74 |
| 74 | Amino acid sequence flanking carboxyl end of head region from H5 Indo (2005) Contains internal loop region. short version |
| 75 | Complement of SEQ ID NO: 73 |
| 76 | Nucleic acid sequence encoding SEQ ID NO: 77 |
| 77 | Amino acid sequence flanking carboxyl end of head region from H5 Indo (2005). Internal loop region replaced with Ser-Gly loop. short version |
| 78 | Complement of SEQ ID NO: 76 |
| | HA CONSTRUCTS 1 |
| 79 | Nucleic acid sequence encoding SEQ ID NO: 80 |
| 80 | Gen_H1NC99_01 (rpk-03) K394M/E446L/E448Q/R449W/D452L H1N1 A/New Caledonia/20/1999 |
| 81 | Complement of SEQ ID NO: 79 |
| 82 | Nucleic acid sequence encoding SEQ ID NO: 83 |
| 83 | Gen6_H1CA09_01 (rpk-3) K394M/E446L/E448Q/R449W/D452L H1N1 A/California/4/2009 |
| 84 | Complement of SEQ ID NO: 82 |
| 85 | Nucleic acid sequence encoding SEQ ID NO: 86 |
| 86 | Gen6_H2Sing57_01 (rpk-3) K394M/M445L/E446L/E448Q/R449W/D452L H2N2 A/Singapore/1957 |
| 87 | Complement of SEQ ID NO: 85 |
| 88 | Nucleic acid sequence encoding SEQ ID NO: 89 |
| 89 | Gen6 H5Ind05_01 (rpk-3) K394M/M445L/E446L/E448Q/R449W/D452L H5N1 A/Indonesia/05/2005 |
| 90 | Complement of SEQ ID NO: 88 |
| 91 | Nucleic acid sequence encoding SEQ ID NO: 92 |
| 92 | Gen6_H1NC99_02 (rpk-22) K394M/E446L H1N1 A/New Caledonia/20/1999 |
| 93 | Complement of SEQ ID NO: 91 |

TABLE 2-continued

| PCT SEQ ID NO | Comments |
|---|---|
| 94 | Nucleic acid sequence encoding SEQ ID NO: 95 |
| 95 | Gen6_H1NC99_03 (rpk-08) V36I/K394M/L445M/E446L/E448Q/W449F/D452L H1N1 A/New Caledonia/20/1999 |
| 96 | Complement of SEQ ID NO: 94 |
| 97 | Nucleic acid sequence encoding SEQ ID NO: 98 |
| 98 | Gen6_H1NC99_04 (rpk-3, gly1) S402bN/G402dT/S402eG/T450A H1N1 A/New Caledonia/20/1999 |
| 99 | Complement of SEQ ID NO: 97 |
| 100 | Nucleic acid sequence encoding SEQ ID NO: 101 |
| 101 | Gen6_H1NC99_05 (rpk-3, gly2) S402bG/G402cN/S402eT/T450A H1N1 A/New Caledonia/20/1999 |
| 102 | Complement of SEQ ID NO: 100 |
| 103 | Nucleic acid sequence encoding SEQ ID NO: 104 |
| 104 | Gen6_H1NC99_06 (rpk-3, gly3) S402eN H1N1 A/New Caledonia/20/1999 |
| 105 | Complement of SEQ ID NO: 103 |
| | HA-FERRITIN FUSIONS |
| 106 | Nucleic acid sequence encoding SEQ ID NO: 107 |
| 107 | Gen_H1NC99_01 (rpk-03) K394M/E446L/E448Q/R449W/D452L H1N1 A/New Caledonia/20/1999 |
| 108 | Complement of SEQ ID NO: 106 |
| 109 | Nucleic acid sequence encoding SEQ ID NO: 110 |
| 110 | Gen6_H1CA09_01 (rpk-3) K394M/E446L/E448Q/R449W/D452L H1N1 A/California/4/2009 |
| 111 | Complement of SEQ ID NO: 109 |
| 112 | Nucleic acid sequence encoding SEQ ID NO: 113 |
| 113 | Gen6_H2Sing57_01 (rpk-3) K394M/M445L/E446L/E448Q/R449W/D452L H2N2 A/Singapore/1957 |
| 114 | Complement of SEQ ID NO: 112 |
| 115 | Nucleic acid sequence encoding SEQ ID NO: 116 |
| 116 | Gen6 H5Ind05_01 (rpk-3) K394M/M445L/E446L/E448Q/R449W/D452L H5N1 A/Indonesia/05/2005 |
| 117 | Complement of SEQ ID NO: 115 |
| 118 | Nucleic acid sequence encoding SEQ ID NO: 119 |
| 119 | Gen6_H1NC99_02 (rpk-22) K394M/E446L H1N1 A/New Caledonia/20/1999 |
| 120 | Complement of SEQ ID NO: 118 |
| 121 | Nucleic acid sequence encoding SEQ ID NO: 122 |
| 122 | Gen6_H1NC99_03 (rpk-08) V36I/K394M/L445M/E446L/E448Q/W449F/D452L H1N1 A/New Caledonia/20/1999 |
| 123 | Complement of SEQ ID NO: 121 |
| 124 | Nucleic acid sequence encoding SEQ ID NO: 125 |
| 125 | Gen6_H1NC99_04 (rpk-3, gly1) S402bN/G402dT/S402eG/T450A H1N1 A/New Caledonia/20/1999 |
| 126 | Complement of SEQ ID NO: 124 |
| 127 | Nucleic acid sequence encoding SEQ ID NO: 128 |
| 128 | Gen6_H1NC99_05 (rpk-3, gly2) S402bG/G402cN/S402eT/T450A H1N1 A/New Caledonia/20/1999 |
| 129 | Complement of SEQ ID NO: 127 |
| 130 | Nucleic acid sequence encoding SEQ ID NO: 131 |
| 131 | Gen6_H1NC99_06 (rpk-3, gly3) S402eN H1N1 A/New Caledonia/20/1999 |
| 132 | Complement of SEQ ID NO: 130 |
| | INTERNAL LOOP SEQUENCES |
| 133 | Internal loop sequence From H1 NC NTQFTAVGKEFNKLERRMENLNKKVDDGFLDIW |
| 134 | NTQFTAVGKEFN; Fragment of SEQ ID NO: 133 |
| 135 | NKLERRMENLNK Fragment of SEQ ID NO: 133 |
| 136 | KKVDDGFLDIW Fragment of SEQ ID NO: 133 |
| 137 | Internal loop sequence from H1 CA 2009 NTQFTAVGKEFNHLEKRIENLNKKVDDGFLDIW |
| 138 | NTQFTAVGKEF; Fragment of SEQ ID NO: 137 |
| 139 | FNHLEKRIENL; Fragment of SEQ ID NO: 137 |
| 140 | LNKKVDDGFLDIW; Fragment of SEQ ID NO: 137 |
| 141 | Internal loop sequence from H5Sing 1957 NTQFEAVGKEFSNLERRLENLNKKMEDGFLDVW |
| 142 | NTQFEAVGKEF; Fragment of SEQ ID NO: 141 |
| 143 | FSNLERRLENLN; Fragment of SEQ ID NO: 141 |
| 144 | NKKMEDGFLDVW; Fragment of SEQ ID NO: 141 |
| 145 | Internal loop sequence from H5 Indo 2005 NTQFEAVGREFNNLERRIENLNKKMEDGFLDVW |
| 146 | NTQFEAVGREF; Fragment of SEQ ID NO: 145 |
| 147 | FNNLERRIENLN; Fragment of SEQ ID NO: 145 |
| 148 | NKKMEDGFLDVW; Fragment of SEQ ID NO: 145 |
| | MUTATION REGIONS |
| 149 | Mutation region for H1 NC 99 KVNSVIEKMNTQFTAVGKEFNKLERRMENLNKKVDDGFLDIWTYNAELLVLLE |

TABLE 2-continued

| PCT SEQ ID NO | Comments |
|---|---|
| 150 | KVNSVIEKMTYNAELLVLLE; SEQ ID NO149 minus internal loop |
| 151 | Mutation region for H1 CA 2009 KVNSVIEKMNTQFTAVGKEFNHLEKRIENLNKKVDDGFLDIWTYNAELLVLLE |
| 152 | KVNSVIEKMTYNAELLVLLE SEQ ID NO: 151 minus internal loop |
| 153 | Mutation region for H2 Sing 1957 KVNSVIEKMNTQFEAVGKEFSNLERRLENLNKKMEDGFLDVWTYNAELLVLME |
| 154 | KVNSVIEKMTYNAELLVLME; SEQ ID NO: 153 minus internal loop |
| 155 | Mutation region for H2 Indo 2005 KVNSIIDKMNTQFEAVGREFNNLERRIENLNKKMEDGFLDVWTYNAELLVLME |
| 156 | KVNSIIDKMTYNAELLVLME; SEQ ID NO: 155 minus internal loop ADDITIONAL CONSTRUCTS |
| 157 | Nucleic acid sequence encoding SEQ ID NO: 158 |
| 158 | Gen6_H1NC99_xx (rpk-22[MM]) K394M/E446M H1N1 A/New Caledonia/20/1999 HA Construct |
| 159 | Complement of SEQ ID NO: 157 |
| 160 | Nucleic acid sequence encoding SEQ ID NO: 161 |
| 161 | Gen6_H1NC99_xx (rpk-22[MM]) K394M/E446M H1N1 A/New Caledonia/20/1999 HA-Ferritin Construct |
| 162 | Complement of SEQ ID NO: 160 |
| 163 | Nucleic acid sequence encoding SEQ ID NO: 164 |
| 164 | Gen6_H1NC99_xx (rpk-22[II]) K394I/E446I H1N1 A/New Caledonia/20/1999 HA Construct |
| 165 | Complement of SEQ ID NO: 163 |
| 166 | Nucleic acid sequence encoding SEQ ID NO: 167 |
| 167 | Gen6_H1NC99_xx (rpk-22[II]) K394I/E446I H1N1 A/New Caledonia/20/1999 HA-Ferritin Construct |
| 168 | Complement of SEQ ID NO: 166 |
| 169 | Nucleic acid sequence encoding SEQ ID NO: 170 |
| 170 | Gen6_H1NC99_xx (rpk-22[LI]) K394I/E446I H1N1 A/New Caledonia/20/1999 HA Construct |
| 171 | Complement of SEQ ID NO: 169 |
| 172 | Nucleic acid sequence encoding SEQ ID NO: 173 |
| 173 | Gen6_H1NC99_xx (rpk-22[LI]) K394I/E446I H1N1 A/New Caledonia/20/1999 HA Ferritin Construct |
| 174 | Complement of SEQ ID NO: 172 |
| 175 | Nucleic acid sequence encoding SEQ ID NO: 176 |
| 176 | Gen6_H1NC99_xx (rpk-22[LL]) K394L/E446L H1N1 A/New Caledonia/20/1999 HA Construct |
| 177 | Complement of SEQ ID NO: 175 |
| 178 | Nucleic acid sequence encoding SEQ ID NO: 179 |
| 179 | Gen6_H1NC99_xx (rpk-22[LL]) K394L/E446L H1N1 A/New Caledonia/20/1999 HA-Ferritin Consruct |
| 180 | Complement of SEQ ID NO: 178 |
| 181 | Nucleic acid sequence encoding SEQ ID NO: 182 |
| 182 | GEN6_H1NC99_06 (RPK-3, GLY2-6-7 (+3 GLY) H1N1 A/NEW CALEDONIA/20/1999 HA Construct |
| 183 | Complement of SEQ ID NO: 181 |
| 184 | Nucleic acid sequence encoding SEQ ID NO: 185 |
| 185 | GEN6_H1NC99_06 (RPK-3, GLY2-6-7 (+3 GLY) H1N1 A/NEW CALEDONIA/20/1999 HA-Ferritin Construct |
| 186 | Complement of SEQ ID NO: 184 |
| 187 | Nucleic acid sequence encoding SEQ ID NO: 188 |
| 188 | GEN6_H1NC99_06 (RPK-3, GLY2-5-6-7 (+4 GLY) H1N1 A/NEW CALEDONIA/20/1999 HA Construct |
| 189 | Complement of SEQ ID NO: 187 |
| 190 | Nucleic acid sequence encoding SEQ ID NO: 191 |
| 191 | GEN6_H1NC99_06 (RPK-3, GLY2-5-6-7 (+4 GLY) H1N1 A/NEW CALEDONIA/20/1999 HA-Ferritin Construct |
| 192 | Complement of SEQ ID NO: 190 |
| 193 | Nucleic acid sequence encoding SEQ ID NO: 194 |
| 194 | SP|O66529|RISB_AQUAE 6,7-DIMETHYL-8-RIBITYLLUMAZINE SYNTHASE OS = AQUIFEX AEOLICUS (STRAIN VF5) LUMAZINE SYNTHASE |
| 195 | Complement of SEQ ID NO: 193 |
| 196 | Nucleic acid sequence encoding SEQ ID NO: 197 |
| 197 | H1-NC99_GEN6_LS-01 HA Construct |
| 198 | Complement of SEQ ID NO: 196 |
| 199 | Nucleic acid sequence encoding SEQ ID NO: 200 |
| 200 | H1-NC99_GEN6_LS-01 HA-Lumazine Construct |
| 201 | Complement of SEQ ID NO: 199 |
| 202 | Nucleic acid sequence encoding SEQ ID NO: 203 |
| 203 | H1-NC99_GEN6_LS-02 HA Construct |
| 204 | Complement of SEQ ID NO: 202 |
| 205 | Nucleic acid sequence encoding SEQ ID NO: 206 |
| 206 | H1-NC99_GEN6_LS-02 HA-Lumazine Construct |
| 207 | Complement of SEQ ID NO: 205 |
| 208 | Nucleic acid sequence encoding SEQ ID NO: 209 |

TABLE 2-continued

| PCT SEQ ID NO | Comments |
|---|---|
| 209 | GEN6_H1NC99_K394M/E446L/E448Q/R449W/D452L/Y437D/N438L_N19Q (RPK-3 WT CLEAVAGE) H1N1 A/NEW CALEDONIA/20/1999 HA Construct |
| 210 | Complement of SEQ ID NO: 208 |
| 211 | Nucleic acid sequence encoding SEQ ID NO: 212 |
| 212 | GEN6_H1NC99_K394M/E446L/E448Q/R449W/D452L/Y437D/N438L_N19Q (RPK-3 WT CLEAVAGE) H1N1 A/NEW CALEDONIA/20/1999 HA-Ferritin Construct |
| 213 | Complement of SEQ ID NO: 211 |
| 214 | GEN6_H1CA09_K394M/E446L/E448Q/R449W/D452L/Y437D/N438L_N19Q (RPK-3 WT CLEAVAGE) H1N1 A/CALIFORNIA/4/2009 HA Construct |
| 215 | GEN6_H1CA09_K394M/E446L/E448Q/R449W/D452L/Y437D/N438L_N19Q (RPK-3 WT CLEAVAGE) H1N1 A/CALIFORNIA/4/2009 HA-Feritin Construct |
| 216 | Nucleic acid sequence encoding SEQ ID NO: 217 |
| 217 | GEN6_H1NC99_K394M/E446L/S339Q/I340R/Q341E/S342T_N19Q (RPK-22, DL->YN WT CLEAVAGE) H1N1 A/NEW CALEDONIA/20/1999 HA Construct |
| 218 | Complement of SEQ ID NO: 216 |
| 219 | Nucleic acid sequence encoding SEQ ID NO: 220 |
| 220 | GEN6_H1NC99_K394M/E446L/S339Q/I340R/Q341E/S342T_N19Q (RPK-22, DL->YN WT CLEAVAGE) H1N1 A/NEW CALEDONIA/20/1999 HA-Ferritin Construct |
| 221 | Complement of SEQ ID NO: 219 |
| 222 | GEN6_H1NC99_K394M/E446L/Y437D/N438L_N19Q (RPK-22, WT CLEAVAGE) H1N1 A/NEW CALEDONIA/20/1999 HA Construct |
| 223 | GEN6_H1NC99_K394M/E446L/Y437D/N438L_N19Q (RPK-22, WT CLEAVAGE) H1N1 A/NEW CALEDONIA/20/1999 HA-Ferritin Construct |
| 224 | GEN6_H1NC99_K394I/E446I/Y437D/N438L_N19Q (RPK-22 [II], WT CLEAVAGE) H1N1 A/NEW CALEDONIA/20/1999 HA Construct |
| 225 | GEN6_H1NC99_K394I/E446I/Y437D/N438L_N19Q (RPK-22 [II], WT CLEAVAGE) H1N1 A/NEW CALEDONIA/20/1999 HA-Ferritin Construct |
| 226 | GEN6_H1NC99_K394L/E446I/Y437D/N438L_N19Q (RPK-22 [LI], WT CLEAVAGE) H1N1 A/NEW CALEDONIA/20/1999 HA Construct |
| 227 | GEN6_H1NC99_K394L/E446I/Y437D/N438L_N19Q (RPK-22 [LI], WT CLEAVAGE) H1N1 A/NEW CALEDONIA/20/1999 HA-Ferritin Construct |
| 228 | GEN6_H1NC99_K394L/E446L/Y437D/N438L_N19Q (RPK-22 [LL], WT CLEAVAGE) H1N1 A/NEW CALEDONIA/20/1999 HA Construct |
| 229 | GEN6_H1NC99_K394L/E446L/Y437D/N438L_N19Q (RPK-22 [LL], WT CLEAVAGE) H1N1 A/NEW CALEDONIA/20/1999 HA-Ferritin Construct |
| 230 | GEN6_H1NC99_K394M/E446M/Y437D/N438L_N19Q (RPK-22 [MM], WT CLEAVAGE) H1N1 A/NEW CALEDONIA/20/1999 HA Construct |
| 231 | GEN6_H1NC99_K394M/E446M/Y437D/N438L_N19Q (RPK-22 [MM], WT CLEAVAGE) H1N1 A/NEW CALEDONIA/20/1999 HA-Ferritin Construct |
| 232 | GEN6_H1NC99_K394Q/E446Q/Y437D/N438L_N19Q (RPK-22 [QQ], WT CLEAVAGE) H1N1 A/NEW CALEDONIA/20/1999 HA Construct |
| 233 | GEN6_H1NC99_K394Q/E446Q/Y437D/N438L_N19Q (RPK-22 [QQ], WT CLEAVAGE) H1N1 A/NEW CALEDONIA/20/1999 HA-Ferritin Construct |
| 234 | Nucleic aicd sequence encoding SEQ ID NO: 235 |
| 235 | GEN6_H1NC99_K394M/E446L/Y437D/N438L/H45N/V47T_N19Q (RPK-22, H3-LIKE GLY, WT CLEAVAGE) H1N1 A/NEW CALEDONIA/20/1999 HA Construct |
| 236 | Complement of SEQ ID NO: 234 |
| 237 | Nucleic aicd sequence encoding SEQ ID NO: 238 |
| 238 | GEN6_H1NC99_K394M/E446L/Y437D/N438L/H45N/V47T_N19Q (RPK-22, H3-LIKE GLY, WT CLEAVAGE) H1N1 A/NEW CALEDONIA/20/1999 HA-Ferritin Construct |
| 239 | Complement of SEQ ID NO: 237 |
| 240 | GEN6_H1NC99_V36I/K394M/L445M/E446L/E448Q/R449F/D452L/Y437D/N438L_N19Q (RPK-08, WT CLEAVAGE) H1N1 A/NEW CALEDONIA/20/1999 HA Construct |
| 241 | GEN6_H1NC99_V36I/K394M/L445M/E446L/E448Q/R449F/D452L/Y437D/N438L_N19Q (RPK-08, WT CLEAVAGE) H1N1 A/NEW CALEDONIA/20/1999 HA-Ferritin Construct |
| 242 | Gen6_H1NC99_K394M/E446L/E448Q/R449W/D452L/S402bN/G402dT/S402eG/T402gA/Y437D/N438L_N19Q (rpk-3, gly1, wt cleavage) H1N1 A/New Caledonia/20/1999 HA Construct |
| 243 | Gen6_H1NC99_K394M/E446L/E448Q/R449W/D452L/S402bN/G402dT/S402eG/T402gA/Y437D/N438L_N19Q (rpk-3, gly1, wt cleavage) H1N1 A/New Caledonia/20/1999 HA-Ferritin construct |
| 244 | Gen6_H1NC99_K394M/E446L/E448Q/R449W/D452L/S402bG/G402cN/S402eT/T402gA/Y437D/N438L_N19Q (rpk-3, gly2, wt cleavage) H1N1 A/New Caledonia/20/1999 HA Construct |
| 245 | Gen6_H1NC99_K394M/E446L/E448Q/R449W/D452L/S402bG/G402cN/S402eT/T402gA/Y437D/N438L_N19Q (rpk-3, gly2, wt cleavage) H1N1 A/New Caledonia/20/1999 HA-Ferritin Construct |
| 246 | GEN6_H1NC99_K394M/E446L/E448Q/R449W/D452L/S402EN/Y437D/N438L_N19Q (RPK-3, GLY3, WT CLEAVAGE) H1N1 A/NEW CALEDONIA/20/1999 HA Construct |
| 247 | GEN6_H1NC99_K394M/E446L/E448Q/R449W/D452L/S402EN/Y437D/N438L_N19Q (RPK-3, GLY3, WT CLEAVAGE) H1N1 A/NEW CALEDONIA/20/1999 HA-Ferritin Construct |

TABLE 2-continued

| PCT SEQ ID NO | Comments |
|---|---|
| 248 | Gen6__H1NC99__K394M/E446L/E448Q/R449W/D452L/G402cN/G402eT/T402gA/Q370N/E372T/Y437D/N438L__S21T (rpk-3, gly2-6-7, wt cleavage) H1N1 A/New Caledonia/20/1999 HA Construct |
| 249 | Gen6__H1NC99__K394M/E446L/E448Q/R449W/D452L/G402cN/G402eT/T402gA/Q370N/E372T/Y437D/N438L__S21T (rpk-3, gly2-6-7, wt cleavage) H1N1 A/New Caledonia/20/1999 HA-Ferritin Construct |
| 250 | Gen6__H1NC99__K394M/E446L/E448Q/R449W/D452L/G402cN/G402eT/T402gA/Q370N/E372T/Y437D/N438L__S21T/Q69N (rpk-3, gly2-5-6-7, wt cleavage) H1N1 A/New Caledonia/20/1999 HA Construct |
| 251 | Gen6__H1NC99__K394M/E446L/E448Q/R449W/D452L/G402cN/G402eT/T402gA/Q370N/E372T/Y437D/N438L__S21T/Q69N (rpk-3, gly2-5-6-7, wt cleavage) H1N1 A/New Caledonia/20/1999 HA-Ferritin Construct |
| 252 | GEN6__H1NC99__LS1__K394M/E446L/Y437D/N438L/Δ515-517 (RPK-22__LS1, WT CLEAVAGE) HA-Construct |
| 253 | GEN6__H1NC99__LS1__K394M/E446L/Y437D/N438L/Δ515-517 (RPK-22__LS1, WT CLEAVAGE)HA-Lumazine Construct |
| 254 | H1-NC99__GEN6__LS2__K394M/E446L/Y437D/N438L/Δ515-517 (RPK-22__LS2, WT CLEAVAGE) HA Construct |
| 255 | H1-NC99__GEN6__LS2__K394M/E446L/Y437D/N438L/Δ515-517(RPK-22__LS2, WT CLEAVAGE) HA-Lumazine Construct |
| 256 | H1-NC99__GEN6__LS3__K394M/E446L/Y437D/N438L/Δ512-517 (RPK-22__LS3, WT CLEAVAGE) HA Construct |
| 257 | H1-NC99__GEN6__LS3__K394M/E446L/Y437D/N438L/Δ512-517 (RPK-22__LS3, WT CLEAVAGE) HA-Lumazine |
| 258 | H1-NC99__GEN6__LS4__K394M/E446L/Y437D/N438L/Δ512-517 (RPK-22__LS4, WT CLEAVAGE)HA Construct |
| 259 | H1-NC99__GEN6__LS4__K394M/E446L/Y437D/N438L/Δ512-517 (RPK-22__LS4, WT CLEAVAGE) HA-Lumazine Construct |
| 260 | Nucleic acid sequence encoding SEQ ID NO: 261 |
| 261 | Gen6__H1NC99__K394M/E446L/E448Q/R449W/D452L/Y437D/N438L__N19Q HA portion of insert |
| 262 | Complement of SEQ ID NO: 260 |
| 263 | Nucleic acid sequence encoding SEQ ID NO: 264 |
| 264 | Gen6__H1NC99__K394M/E446L/E448Q/R449W/D452L/Y437D/N438L__N19Q HA-Ferritin insert |
| 265 | Complement of SEQ ID NO: 263 |
| 266 | Sequence of entire plasmid from FIG. 5 |
| 267 | Nucleic acid sequence encoding SEQ ID NO: 268 |
| 268 | Gen6__H1CA09__K394M/E446L/E448Q/R449W/D452L/Y437D/N438L__N19Q HA portion of insert |
| 269 | Complement of SEQ ID NO: 267 |
| 270 | Nucleic acid sequence encoding SEQ ID NO: 271 |
| 271 | Gen6__H1CA09__K394M/E446L/E448Q/R449W/D452L/Y437D/N438L__N19Q HA-Ferritin insert |
| 272 | Complement of SEQ ID NO: 270 |
| 273 | Sequence of entire plasmid from FIG. 6 |
| 274 | Nucleic acid sequence encoding SEQ ID NO: 275 |
| 275 | Gen6__H2Sing57__K394M/M445L/E446L/E448Q/R449W/D452L/Y437D/N438L__N19Q HA portion of insert |
| 276 | Complement of SEQ ID NO: 274 |
| 277 | Nucleic acid sequence encoding SEQ ID NO: 278 |
| 278 | Gen6__H2Sing57__K394M/M445L/E446L/E448Q/R449W/D452L/Y437D/N438L__N19Q HA-Ferritin insert |
| 279 | Complement of SEQ ID NO: 277 |
| 280 | Sequence of entire plasmid from FIG. 7 |
| 281 | Nucleic acid sequence encoding SEQ ID NO: 282 |
| 282 | Gen6__H5Ind05__K394M/M445L/E446L/E448Q/R449W/D452L/Y437D/N438L/S49bW__N19Q HA portion of insert |
| 283 | Complement of SEQ ID NO: 281 |
| 284 | Nucleic acid sequence encoding SEQ ID NO: 285 |
| 285 | Gen6__H5Ind05__K394M/M445L/E446L/E448Q/R449W/D452L/Y437D/N438L/S49bW__N19Q HA-Ferritin insert |
| 286 | Complement of SEQ ID NO: 284 |
| 287 | Sequence of entire plasmid from FIG. 8 |
| 288 | Nucleic acid sequence encoding SEQ ID NO: 289 |
| 289 | Gen6__H1NC99__K394M/E446L__N19Q HA portion of insert |
| 290 | Complement of SEQ ID NO: 288 |
| 291 | Nucleic acid sequence encoding SEQ ID NO: 292 |
| 292 | Gen6__H1NC99__K394M/E446L__N19Q HA-Ferritin insert |
| 293 | Complement of SEQ ID NO: 291 |
| 294 | Sequence of entire plasmid from FIG. 9 |
| 295 | Nucleic acid sequence encoding SEQ ID NO: 296 |
| 296 | Gen6__H1NC99__K394M/E446L/Y437D/N438L__N19Q HA portion of insert |
| 297 | Compement of SEQ ID NO: 295 |
| 298 | Nucleic acid sequence encoding SEQ ID NO: 299 |
| 299 | Gen6__H1NC99__K394M/E446L/Y437D/N438L__N19Q HA-Ferritin insert |
| 300 | Complement of SEQ ID NO: 298 |

TABLE 2-continued

| PCT SEQ ID NO | Comments |
|---|---|
| 301 | Sequence of entire plasmid from FIG. 10 |
| 302 | Nucleic acid sequence encoding SEQ ID NO: 303 |
| 303 | Gen6_H1NC99_K394I/E446I/Y437D/N438L_N19Q HA portion of insert |
| 304 | Complement of SEQ ID NO: 302 |
| 305 | Nucleic acid sequence encoding SEQ ID NO: 306 |
| 306 | Gen6_H1NC99_K394I/E446I/Y437D/N438L_N19Q HA-Ferritin insert |
| 307 | Complement of SEQ ID NO: 305 |
| 308 | Sequence of entire plasmid from FIG. 11 |
| 309 | Nucleic acid sequence encoding SEQ ID NO: 310 |
| 310 | Gen6_H1NC99_K394L/E446I/Y437D/N438L_N19Q HA portion of insert |
| 311 | Complement of SEQ ID NO: 309 |
| 312 | Nucleic acid sequence encoding SEQ ID NO: 313 |
| 313 | Gen6_H1NC99_K394L/E446I/Y437D/N438L_N19Q HA-Ferritin Insert |
| 314 | Complement of SEQ ID NO: 312 |
| 315 | Sequence of entire plasmid from FIG. 12 |
| 316 | Nucleic acid sequence encoding SEQ ID NO: 317 |
| 317 | Gen6_H1NC99_K394L/E446L/Y437D/N438L_N19Q HA portion of Insert |
| 318 | Complement of SEQ ID NO: 316 |
| 319 | Nucleic acid sequence encoding SEQ ID NO: 320 |
| 320 | Gen6_H1NC99_K394L/E446L/Y437D/N438L_N19Q HA-Ferritin Insert |
| 321 | Complement of SEQ ID NO: 319 |
| 322 | Sequence of entire plasmid from FIG. 13 |
| 323 | Nucleic acid sequence encoding SEQ ID NO: 324 |
| 324 | Gen6_H1NC99_K394M/E446M/Y437D/N438L_N19Q HA portion of Insert |
| 325 | Complement of SEQ ID NO: 323 |
| 326 | Nucleic acid sequence encoding SEQ ID NO: 327 |
| 327 | Gen6_H1NC99_K394M/E446M/Y437D/N438L_N19Q HA-Ferritin Insert |
| 328 | Complement of SEQ ID NO: 326 |
| 329 | Sequence of entire plasmid from FIG. 14 |
| 330 | Nucleic acid sequence encoding SEQ ID NO: 331 |
| 331 | Gen6_H1NC99_K394Q/E446Q/Y437D/N438L_N19Q HA portion of Insert |
| 332 | Complement of SEQ ID NO: 330 |
| 333 | Nucleic acid sequence encoding SEQ ID NO: 334 |
| 334 | Gen6_H1NC99_K394Q/E446Q/Y437D/N438L_N19Q HA-Ferritin Insert |
| 335 | Complement of SEQ ID NO: 333 |
| 336 | Sequence of entire plasmid from FIG. 15 |
| 337 | Nucleic acid sequence encoding SEQ ID NO: 338 |
| 338 | Gen6_H1NC99_K394M/E446L/Y437D/N438L/H45N/V47T_N19Q HA portion of Insert |
| 339 | Complement of SEQ ID NO: 337 |
| 340 | Nucleic acid sequence encoding SEQ ID NO: 341 |
| 341 | Gen6_H1NC99_K394M/E446L/Y437D/N438L/H45N/V47T_N19Q HA-Ferritin Insert |
| 342 | Complement of SEQ ID NO: 340 |
| 343 | Sequence of entire plasmid from FIG. 16 |
| 344 | Nucleic acid sequence encoding SEQ ID NO: 345 |
| 345 | Gen6_H1NC99_V36I/K394M/L445M/E446L/E448Q/R449F/D452L/Y437D/N438L_N19Q HA portion of Insert |
| 346 | Complement of SEQ ID NO: 344 |
| 347 | Nucleic acid sequence encoding SEQ ID NO: 348 |
| 348 | Gen6_H1NC99_V36I/K394M/L445M/E446L/E448Q/R449F/D452L/Y437D/N438L_N19Q HA-Ferritin Insert |
| 349 | Complement of SEQ ID NO: 347 |
| 350 | Sequence of entire plasmid from FIG. 17 |
| 351 | Nucleic acid sequence encoding SEQ ID NO: 352 |
| 352 | Gen6_H1NC99_K394M/E446L/E448Q/R449W/D452L/S402bN/G402dT/S402eG/T402gA/Y437D/N438L_N19Q HA portion of Insert |
| 353 | Complement of SEQ ID NO: 351 |
| 354 | Nucleic acid sequence encoding SEQ ID NO: 355 |
| 355 | Gen6_H1NC99_K394M/E446L/E448Q/R449W/D452L/S402bN/G402dT/S402eG/T402gA/Y437D/N438L_N19Q HA-Ferritin Insert |
| 356 | Complement of SEQ ID NO: 354 |
| 357 | Sequence of entire plasmid from FIG. 18 |
| 358 | Nucleic acid sequence encoding SEQ ID NO: 359 |
| 359 | Gen6_H1NC99_K394M/E446L/E448Q/R449W/D452L/S402bG/G402cN/S402eT/T402gA/Y437D/N438L_N19Q HA portion of Insert |
| 360 | Complement of SEQ ID NO: 358 |
| 361 | Nucleic acid sequence encoding SEQ ID NO: 362 |
| 362 | Gen6_H1NC99_K394M/E446L/E448Q/R449W/D452L/S402bG/G402cN/S402eT/T402gA/Y437D/N438L_N19Q HA-Ferritin Insert |
| 363 | Complement of SEQ ID NO: 361 |
| 364 | Sequence of entire plasmid from FIG. 19 |
| 365 | Nucleic acid sequence encoding SEQ ID NO: 366 |
| 366 | Gen6_H1NC99_K394M/E446L/E448Q/R449W/D452L/S402eN/Y437D/N438L_N19Q HA portion of Insert |
| 367 | Complement of SEQ ID NO: 365 |
| 368 | Nucleic acid sequence encoding SEQ ID NO: 369 |

TABLE 2-continued

Figure 23:
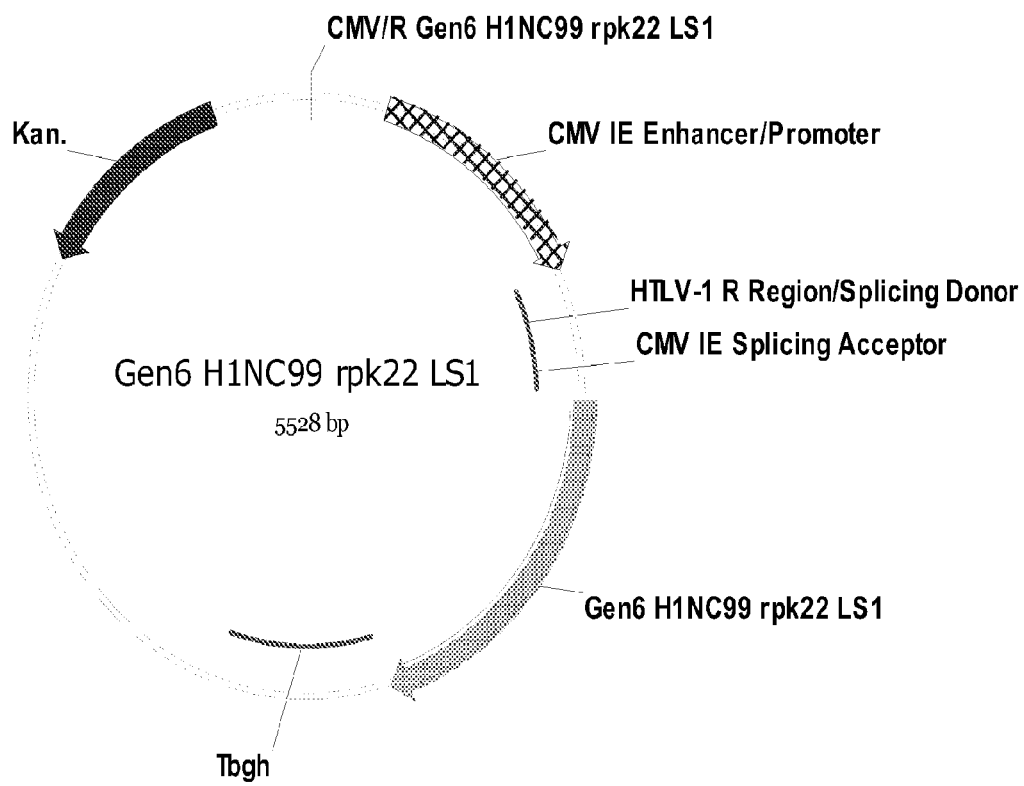
Figure 24:
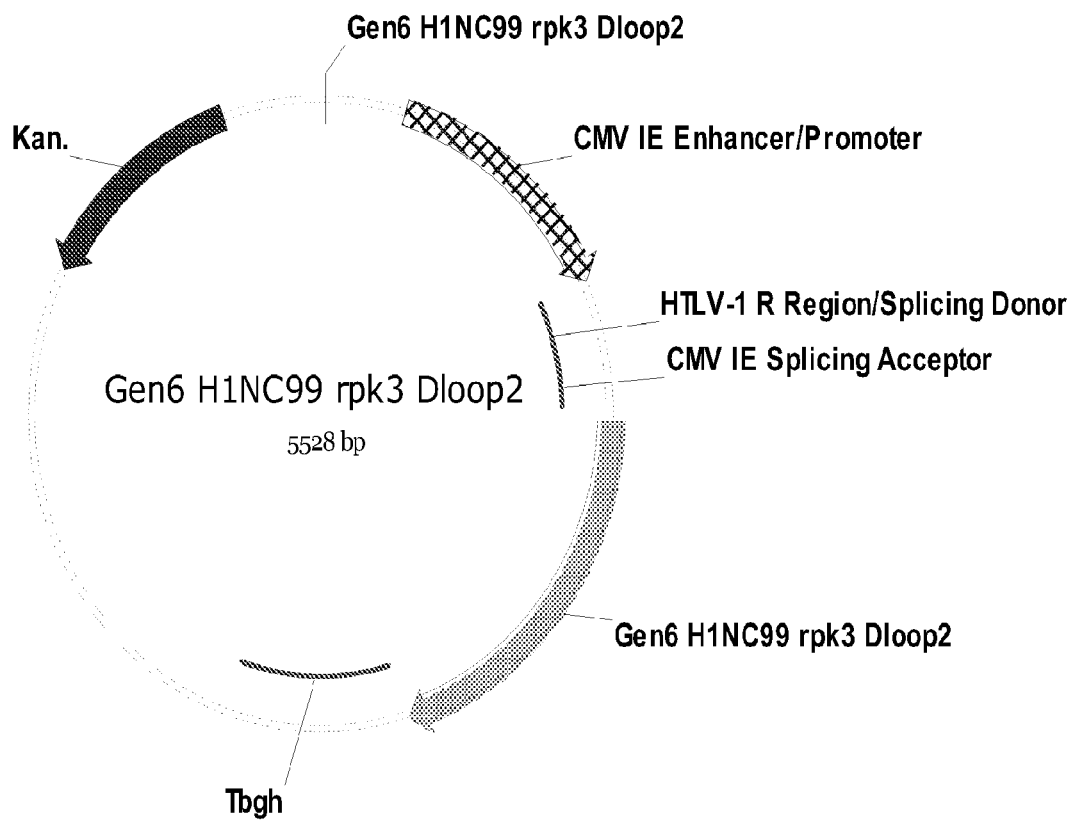

| PCT SEQ ID NO | Comments |
|---|---|
| 369 | Gen6_H1NC99_K394M/E446L/E448Q/R449W/D452L/S402eN/Y437D/N438L_N19Q HA-Ferritin Insert |
| 370 | Complement of SEQ ID NO: 368 |
| 371 | Sequence of entire plasmid from FIG. 20 |
| 372 | Nucleic acid sequence encoding SEQ ID NO: 373 |
| 373 | Gen6_H1NC99_K394M/E446L/E448Q/R449W/D452L/G402dN/G402fT/T402gA/Q370N/E372T/Y437D/N438L_S21T HA portion of Insert |
| 374 | Complement of SEQ ID NO: 372 |
| 375 | Nucleic acid sequence encoding SEQ ID NO: 376 |
| 376 | Gen6_H1NC99_K394M/E446L/E448Q/R449W/D452L/G402dN/G402fT/T402gA/Q370N/E372T/Y437D/N438L_S21T HA-Ferritin Insert |
| 377 | Complement of SEQ ID NO: 375 |
| 378 | Sequence of entire plasmid from FIG. 21 |
| 379 | Nucleic acid sequence encoding SEQ ID NO: 380 |
| 380 | Gen6_H1NC99_K394M/E446L/E448Q/R449W/D452L/G402dN/G402fT/T402gA/Q370N/E372T/Y437D/N438L_S21T/Q69N HA portion of Insert |
| 381 | Complement of SEQ ID NO: 379 |
| 382 | Nucleic acid sequence encoding SEQ ID NO: 383 |
| 383 | Gen6_H1NC99_K394M/E446L/E448Q/R449W/D452L/G402dN/G402fT/T402gA/Q370N/E372T/Y437D/N438L_S21T/Q69N HA-Ferritin Insert |
| 384 | Complement of SEQ ID NO: 382 |
| 385 | Sequence of entire plasmid from FIG. 22 |
| 386 | Nucleic acid sequence encoding SEQ ID NO: 387 |
| 387 | Gen6_H1NC99_K394M/E446L/Y437D/N438L/Δ515-517 HA portion of insert |
| 388 | Complement of SEQ ID NO: 386 |
| 389 | Nucleic acid sequence encoding SEQ ID NO: 390 |
| 390 | Gen6_H1NC99_K394M/E446L/Y437D/N438L/Δ515-517 HA-Ferritin Insert |
| 391 | Complement of SEQ ID NO: 389 |
| 392 | Sequence of entire plasmid from FIG. 23 |
| 393 | Nucleic acid sequence encoding SEQ ID NO: 394 |
| 394 | Gen6_H1NC99_rpk3Dloop2 |
| 395 | Complement of SEQ ID NO: 393 |
| 396 | Nucleic acid sequence encoding SEQ ID NO: 397 |
| 397 | Gen6_H1NC99_rpk3Dloop2 |
| 398 | Complement of SEQ ID NO: 396 |
| 399 | Sequence of entire plasmid from FIG. 24 |
| 400 | Gen6_H1NC99_K394M/E446L/E448Q/R449W/D452L/Y437D/N438L/I337G/G355S/Δ338-354_N19Q (rpk-3, Dloop2) H1N1 A/New Caledonia/20/1999 HA Construct |
| 401 | Gen6_H1NC99_K394M/E446L/E448Q/R449W/D452L/Y437D/N438L/I337G/G355S/Δ338-354_N19Q (rpk-3, Dloop2) H1N1 A/New Caledonia/20/1999 HA-Ferritin Construct |

The trimeric HA protein on the surface of the virus comprises a globular head region and a stem, or stalk, region, which anchors the HA protein into the viral lipid envelope. The head region of influenza HA is formed exclusively from a major portion of the HA1 polypeptide, whereas the stalk region is made from segments of HA1 and HA2. According to the present invention, the head region consists of, approximately, the amino acids of an HA protein corresponding to amino acids 59-291 of the full-length HA protein of influenza H1N1 NC (SEQ ID NO:8). Similarly, as used herein, the stem region consists of, approximately, amino acids 1-58 and the amino acids of an HA protein corresponding to amino acids 328-564 of the full-length HA protein of influenza H1N1 NC (SEQ ID NO:8). As used herein, the term approximately, with regard to the head and stem regions means that the sequences cited above may vary in length by several amino acids without affecting the nature of the invention. Thus, for example, the head region may consist of amino acids 50-291, amino acids 59-296 or amino acids 59-285. Generally the head and stem region will not vary from the locations recited above by more than ten amino acids; however, in one embodiment the carboxy end of the head region can extend as far as an amino acid corresponding to amino acid 327 of SEQ ID NO:8. In one embodiment, the head region consists of the amino acid sequence between, and including, the amino acid residues corresponding to Cys59 and Cys291 of influenza A/New Caledonia/20/1999 (SEQ ID NO:8). With regard to HA proteins, it is understood by those skilled in the art that HA proteins from different influenza viruses may have different lengths due to mutations (insertions, deletions) in the protein. Thus, reference to a corresponding region refers to a region of another proteins that is identical, or nearly so (e.g., at least 90% identical, at least 95%, identical, at least 98% identical or at least 99% identical), in sequence, structure and/or function to the region being compared. For example, with regard to the stem region of an HA protein, the corresponding region in another HA protein may not have the same residue numbers, but will have a nearly identical sequence and will perform the same function. As an example, in the embodiment stated above, the head region of the HA protein from A/New Caledonia/20/1999 (SEQ ID NO:8) ends at amino acid C291. The corresponding amino acid at the end of the head region in A/California/4/2009 (H1) (SEQ ID NO:11) is cysteine 292. To better clarify sequences comparisons between viruses, numbering systems are used by those in the field, which relate amino acid positions to a reference sequence. Thus, corresponding amino acid residues in HA proteins from different strains of influenza may not have the same residue number with respect to their distance from the n-terminal amino acid of the protein. For example, using the H3 numbering system, reference to residue 100 in A/New Caledonia/20/1999 (1999 NC, H1) does not mean it is the $100^{th}$ residue from the N-terminal amino acid. Instead, residue 100 of A/New Caledonia/20/1999 (1999 NC, H1) aligns with residue 100 of influenza H3N2 strain. The use of such numbering systems is understood by those skilled in the art. While the H3 numbering system can be used to identify the location of amino acids, unless otherwise noted, the location of amino acid residues in HA proteins will be identified by general reference to the position of a corresponding amino acid from a sequence disclosed herein.

The inventors have also discovered that by combining specific sequences of the influenza virus HA protein with unrelated molecules that are capable of presenting the HA protein to the immune system, immune responses to targeted regions of the HA protein can be elicited. One embodiment of the present invention is a protein construct comprising an influenza HA protein joined to at least a portion of a monomeric subunit protein, wherein the head region of the influenza HA protein has been replaced with an amino acid sequence comprising less than 5 contiguous amino acid residues from the head region of the HA protein, and wherein the protein construct is capable of forming a nanoparticle.

By joining at least a portion of the influenza HA protein to a monomeric subunit, protein constructs of the present invention are capable of assembling into nanoparticles expressing trimers of HA on their surface. It should be appreciated that the HA proteins making up such trimers are in a pre-fusion form and that connection to the monomeric subunit and expression on a nanoparticle stabilize the pre-fusion proteins in their trimeric form. This is significant since the HA protein is presented in a more native form meaning certain surfaces of the stem polypeptides are not exposed, thereby reducing the risk that the stem polypeptides may induce an unfavorable antibody response.

In one embodiment, the HA protein comprises at least one immunogenic portion from the stem region of influenza HA protein, wherein the protein elicits protective antibodies against an influenza virus. In one embodiment, the HA protein comprises at least one immunogenic portion from the stem region of an HA protein from a virus selected from the group consisting of influenza type A viruses, influenza type B viruses and influenza type C viruses, wherein the protein elicits protective antibodies against an influenza virus. In one embodiment, the HA protein comprises at least one immunogenic portion from the stem region of an HA protein selected from the group consisting of an H1 influenza virus HA protein, an H2 influenza virus HA protein, an influenza H3 virus HA protein, an influenza H4 virus HA protein, an influenza H5 virus HA protein, an influenza H6 virus HA protein, an H7 influenza virus HA protein, an H8 influenza virus HA protein, an H9 influenza virus HA protein, an H10 influenza virus HA protein HA protein, an H11 influenza virus HA protein, an H12 influenza virus HA protein, an H13 influenza virus HA protein, an H14 influenza virus HA protein, an H15 influenza virus HA protein, an H16 influenza virus HA protein, an H17 influenza virus HA protein, and an H18 influenza virus HA protein.

In one embodiment, the HA protein comprises at least one immunogenic portion from a protein comprising an amino acid sequence at least 80% identical to a sequence selected from the group consisting of SEQ ID NO:8, SEQ ID NO:11, SEQ ID NO:14 and SEQ ID NO:17. In one embodiment, the HA protein comprises at least one immunogenic portion from a protein comprising an amino acid sequence selected from the group consisting of SEQ ID NO:8, SEQ ID NO:11, SEQ ID NO:14 and SEQ ID NO:17. In one embodiment, the HA protein comprises at least one immunogenic portion from a protein comprising an amino acid sequence at least 80% identical to a sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:150, SEQ ID NO:152, SEQ ID NO:154, SEQ ID NO:156, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400. In one embodiment, the HA protein comprises at least one immunogenic portion from a protein comprising an amino acid sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:150, SEQ ID NO:152, SEQ ID NO:154, SEQ ID NO:156, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400. In one embodiment, such proteins comprising immunogenic portions of the HA protein elicit the production of broadly protective antibodies against influenza virus.

Immunogenic portions of proteins comprise epitopes, which are clusters of amino acid residues that are recognized by the immune system, thereby eliciting an immune response. Such epitopes may consist of contiguous amino acids residues (i.e., amino acid residues that are adjacent to one another in the protein), or they may consist of non-contiguous amino acid residues (i.e., amino acid residues that are not adjacent one another in the protein) but which are in close special proximity in the finally folded protein. It is well understood by those skilled in the art that epitopes require a minimum of six amino acid residues in order to be recognized by the immune system. Thus, in one embodiment the immunogenic portion from the influenza HA protein comprises at least one epitope. In one embodiment the HA protein comprises at least 6 amino acids, at least 10 amino acids, at least 25 amino acids, at least 50 amino acids, at least 75 amino acids or at least 100 amino acids from the stem region of influenza HA protein. In one embodiment the HA protein comprises at least 6 amino acids, at least 10 amino acids, at least 25 amino acids, at least 50 amino acids, at least 75 amino acids or at least 100 amino acids from the stem region of an HA protein from a virus selected from the group consisting of influenza type A viruses, influenza type B viruses and influenza type C viruses. In one embodiment the HA protein comprises at least 6 amino acids, at least 10 amino acids, at least 25 amino acids, at least 50 amino acids, at least 75 amino acids or at least 100 amino acids from the stem region of an HA protein selected from the group consisting an H1 influenza virus HA protein, an H2 influenza virus HA protein, an influenza H3 virus HA protein, an influenza H4 virus HA protein, an influenza H5 virus HA protein, an influenza H6 virus HA protein, an H7 influenza virus HA protein, an H8 influenza virus HA protein, an H9 influenza virus HA protein, an H10 influenza virus HA protein HA protein, an H11 influenza virus HA protein, an H12 influenza virus HA protein, an H13 influenza virus HA protein, an H14 influenza virus HA protein, an H15 influenza virus HA protein, an H16 influenza virus HA protein, an H17 influenza virus HA protein, and an H18 influenza virus HA protein. In one embodiment the HA protein comprises at least 6 amino acids, at least 10 amino acids, at least 25 amino acids, at least 50 amino acids, at least 75 amino acids or at least 100 amino acids from the stem region of an HA protein from a strain of virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B), and variants thereof. In one embodiment, the amino acids are contiguous amino acids from the stem region of the HA protein. In one embodiment, such proteins comprising at least 6 amino acids, at least 10 amino acids, at least 25 amino acids, at least 50 amino acids, at least 75 amino acids or at least 100 amino acids from the stem region of an HA protein elicit the production of broadly protective antibodies against influenza virus. One embodiment of the present invention is a protein construct comprising at least 6 amino acids, at least 10 amino acids, at least 25 amino acids, at least 50 amino acids, at least 75 amino acids or at least 100 amino acids from the stem region of an HA protein comprising an amino acid sequence selected from the group consisting of SEQ ID NO:8, SEQ ID NO:11, SEQ ID NO:14 and SEQ ID NO:17. One embodiment of the present invention is a protein construct comprising at least 6 amino acids, at least 10 amino acids, at least 25 amino acids, at least 50 amino acids, at least 75 amino acids or at least 100 amino acids from the stem region of an HA protein comprising an amino acid sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:150, SEQ ID NO:152, SEQ ID NO:154, SEQ ID NO:156, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400. In one embodiment, the amino acids are contiguous amino acids from the stem region of the HA protein. In one embodiment, the amino acids are non-contiguous, but are in close spatial proximity in the final protein.

While the present application exemplifies the use of stem region sequences from several exemplary HA proteins, the invention may also be practiced using stem regions from proteins comprising variations of the disclosed HA sequences. Thus, in one embodiment, the HA protein is from a virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B), and variants thereof. In one embodiment of the HA protein comprises an amino acid sequence at least 80%, at least 85%, at least 90%, at least 92%, at least 94%, at least 96%, at least 98% or at least 99% identical the stem region of an HA protein comprising an amino acid sequence selected from the group consisting of SEQ ID NO:8, SEQ ID NO:, SEQ ID NO:11, SEQ ID NO:14, SEQ ID NO:17. In one embodiment the HA protein comprises an amino acid sequence selected from the group consisting of SEQ ID NO:8, SEQ ID NO:, SEQ ID NO:11, SEQ ID NO:14, SEQ ID NO:17.

In one embodiment, the head region sequence of the HA protein is replaced with a linker sequence. Any linker sequence may be used so long as the stem region sequences are able to form the desired structure. While any amino acids may be used to make the linker sequence, it is preferred to use amino acids lacking large or charged side chains. Preferred amino acids include, but are not limited to, serine, glycine and alanine. In one embodiment, the linker is made from serine and glycine residues. The length of the linker sequence may vary, but preferred embodiments use the shortest possible sequence in order to allow the stem sequences to form the desired structure. In one embodiment, the linker sequence is less than 10 amino acids in length. In one embodiment, the linker sequence is less than 5 amino acids in length. In preferred embodiments, the linker sequence lacks contiguous amino acid sequences from the head region of an HA protein. In one embodiment, the linker sequence comprises less than 5 contiguous amino acids from the head region of an HA protein.

As noted above, the HA sequence is linked to a portion of a monomeric subunit protein. As used herein, a monomeric subunit protein refers to a protein monomer that is capable of binding to other monomeric subunit proteins such that the monomeric subunit proteins self-assemble into a nanoparticle. Any monomeric subunit protein can be used to produce the protein construct of the present invention, so long as the protein construct is capable of forming a multimeric structure displaying HA protein on its surface. In one embodiment the monomeric subunit is ferritin.

Ferritin is a globular protein found in all animals, bacteria, and plants, that acts primarily to control the rate and location of polynuclear $Fe(III)_2O_3$ formation through the transportation of hydrated iron ions and protons to and from a mineralized core. The globular form of ferritin is made up of monomeric subunit proteins (also referred to as monomeric ferritin subunits), which are polypeptides having a molecule weight of approximately 17-20 kDa. An example of the sequence of one such monomeric ferritin subunit is represented by SEQ ID NO:2. Each monomeric ferritin subunit has the topology of a helix bundle which includes a four antiparallel helix motif, with a fifth shorter helix (the c-terminal helix) lying roughly perpendicular to the long axis of the 4 helix bundle. According to convention, the helices are labeled 'A, B, C, and D & E' from the N-terminus respectively. The N-terminal sequence lies adjacent to the nanoparticle three-fold axis and extends to the surface, while the E helices pack together at the four-fold axis with the C-terminus extending into the particle core. The consequence of this packing creates two pores on the nanoparticle surface. It is expected that one or both of these pores represent the point by which the hydrated iron diffuses into and out of the nanoparticle. Following production, these monomeric ferritin subunit proteins self-assemble into the globular ferritin protein. Thus, the globular form of ferritin comprises 24 monomeric, ferritin subunit proteins, and has a capsid-like structure having 432 symmetry.

According to the present invention, a monomeric ferritin subunit of the present invention is a full length, single polypeptide of a ferritin protein, or any portion thereof, which is capable of directing self-assembly of monomeric ferritin subunits into the globular form of the protein. Examples of such proteins include, but are not limited to SEQ ID NO:2 and SEQ ID NO:5. Amino acid sequences from monomeric ferritin subunits of any known ferritin protein can be used to produce protein constructs of the present invention, so long as the monomeric ferritin subunit is capable of self-assembling into a nanoparticle displaying HA on its surface. In one embodiment, the monomeric subunit is from a ferritin protein selected from the group consisting of a bacterial ferritin protein, a plant ferritin protein, an algal ferritin protein, an insect ferritin protein, a fungal ferritin protein and a mammalian ferritin protein. In one embodiment, the ferritin protein is from *Helicobacter pylori*.

Protein constructs of the present invention need not comprise the full-length sequence of a monomeric subunit polypeptide of a ferritin protein. Portions, or regions, of the monomeric ferritin subunit protein can be utilized so long as the portion comprises an amino acid sequence that directs self-assembly of monomeric ferritin subunits into the globular form of the protein. One example of such a region is located between amino acids 5 and 167 of the *Helicobacter pylori* ferritin protein. More specific regions are described in Zhang, Y. Self-Assembly in the Ferritin Nano-Cage Protein Super Family. 2011, Int. J. Mol. Sci., 12, 5406-5421, which is incorporated herein by reference in its entirety.

In one embodiment the HA protein is joined to at least 50, at least 100 or least 150 amino acids from ferritin, wherein the protein construct is capable of forming a nanoparticle. In one embodiment the HA protein is joined to at least 50, at least 100 or least 150 amino acids from SEQ ID NO:2 or SEQ ID NO:5, wherein the protein construct is capable of forming a nanoparticle. In one embodiment the HA protein is joined to a protein comprising an amino acid sequence at least 85%, at least 90% or at least 95% identical to the sequence of ferritin, wherein the protein construct is capable of forming a nanoparticle. In one embodiment the HA protein is joined to a protein comprising an amino acid sequence at least 85%, at least 90%, at least 95% identical to SEQ ID NO:2 or SEQ ID NO:5, wherein the protein construct is capable of forming a nanoparticle.

In one embodiment the monomeric subunit is lumazine synthase. In one embodiment the HA protein is joined to at least 50, at least 100 or least 150 amino acids from lumazine synthase, wherein the protein construct is capable of forming a nanoparticle. Thus, in one embodiment the HA protein is joined to a protein at least 85%, at least 90%, at least 95% identical to lumazine synthase, wherein the protein construct is capable of forming a nanoparticle.

As used herein, a nanoparticle of the present invention refers to a three-dimensional particle formed by self-assembly of protein constructs (fusion proteins) of the present invention. Nanoparticles of the present invention are generally spheroid in shape, although other shapes are not excluded, and are generally from about 20 nm to about 100 nm in diameter. Nanoparticles of the present invention may, but need not, comprise other molecules, such as proteins, lipids, carbohydrates, etc., than the protein constructs from which they are formed.

Protein constructs of the present invention can be made using recombinant technology to link together portions of HA proteins, linkers and monomeric subunits. In this way, protein constructs can be produced that comprise only those sequences necessary to produce nanoparticle vaccines. Thus, one embodiment of the present invention is a protein construct (also referred to as a fusion protein) comprising a first amino acid sequence from the stem region of an influenza virus HA protein and a second amino acid sequence from the stem region of an influenza virus HA protein, the first and second amino acid sequences being covalently linked by a linker sequence,
   wherein the first amino acid sequence comprises at least 20 contiguous amino acid residues from the amino acid sequence upstream of the amino-terminal end of the head region sequence;
   wherein the second amino acid sequence comprises at least 20 contiguous amino acid residues from the amino acid sequence downstream of the carboxyl-terminal end of the head region sequence; and,
   wherein the first or second amino acid sequence is joined to at least a portion of a monomeric subunit domain such that the protein construct is capable of forming a nanoparticle.

In one embodiment, the first amino acid sequence is from the stem region of an HA protein from a virus selected from the group consisting of influenza A viruses, influenza B viruses and influenza C viruses. In one embodiment, the first amino acid sequence is from the stem region of an HA protein from a virus selected from the group consisting of an H1 influenza virus, an H2 influenza virus, an influenza H3 virus, an influenza H4 virus, an influenza H5 virus, an influenza H6 virus, an H7 influenza virus, an H8 influenza virus, an H9 influenza virus, an H10 influenza virus, an H11 influenza virus, an H12 influenza virus, an H13 influenza virus, an H14 influenza virus, an H15 influenza virus, an H16 influenza virus, an H17 influenza virus, and an H18 influenza virus. In one embodiment, the first amino acid sequence is from the stem region of an HA protein from a virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B). In one embodiment, the first amino acid sequence is from the stem region of an HA protein having an amino acid sequences at least 85%, at least 90%, at least 95% or at least 97% identical to a sequence selected from the group consisting of SEQ ID NO:8, SEQ ID NO:, SEQ ID NO:11, SEQ ID NO:14 and SEQ ID NO:17. In one embodiment, the first amino acid sequence is from the stem region of an HA protein comprising a sequence selected from the group consisting of SEQ ID NO:8, SEQ ID NO:11, SEQ ID NO:14 and SEQ ID NO:17. In one embodiment, the HA protein comprises at least one immunogenic portion from a protein comprising an amino acid sequence at least 85%, at least 90%, at least 95% or at least 97% identical to a sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:150, SEQ ID NO:152, SEQ ID NO:154, SEQ ID NO:156, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400. In one embodiment, the HA protein comprises at least one immunogenic portion from a protein comprising an amino acid sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:150, SEQ ID NO:152, SEQ ID NO:154, SEQ ID NO:156, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400.

In one embodiment, the second amino acid sequence is from the stem region of an HA protein from a virus selected from the group consisting of influenza A viruses, influenza B viruses and influenza C viruses. In one embodiment, the second amino acid sequence is from the stem region of an HA protein from a virus selected from the group consisting of an H1 influenza virus, an H2 influenza virus, an influenza H3 virus, an influenza H4 virus, an influenza H5 virus, an influenza H6 virus, an H7 influenza virus, an H8 influenza virus, an H9 influenza virus, an H10 influenza virus, an H11 influenza virus, an H12 influenza virus, an H13 influenza virus, an H14 influenza virus, an H15 influenza virus, an H16 influenza virus, an H17 influenza virus, and an H18 influenza virus. In one embodiment, the second amino acid sequence is from the stem region of an HA protein from a virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B). In one embodiment, the second amino acid sequence is from the stem region of an HA protein having an amino acid sequences at least 85%, at least 90%, at least 95% or at least 97% identical to a sequence selected from the group consisting of SEQ ID NO:8, SEQ ID NO:11, SEQ ID NO:14 and SEQ ID NO:17. In one embodiment, the second amino acid sequence is from the stem region of an HA protein comprising a sequence selected from the group consisting of SEQ ID NO:8, SEQ ID NO:11, SEQ ID NO:14 and SEQ ID NO:17. In one embodiment, the HA protein comprises at least one immunogenic portion from a protein comprising an amino acid sequence at least 85%, at least 90%, at least 95% or at least 97% identical to a sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:150, SEQ ID NO:152, SEQ ID NO:154, SEQ ID NO:156, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400. In one embodiment, the HA protein comprises at least one immunogenic portion from a protein comprising an amino acid sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:150, SEQ ID NO:152, SEQ ID NO:154, SEQ ID NO:156, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400.

As noted above, the first amino acid sequence comprises at least 20 contiguous amino acid residues from the amino acid sequence upstream of the amino-terminal end of the head region sequence. According to the present invention, the term upstream refers to the entirety of the amino acid sequence linked to the amino-terminal end of the first amino acid residue of the head region. In one embodiment, the amino-terminal end of the head region is located at the amino acid residue corresponding to Cys59 of the HA protein of influenza A New Caledonia/20/1999 (H1) (SEQ ID NO:8) Thus, in one embodiment, the first amino acid sequence comprises at least 20 contiguous amino acid residues from the region of an HA protein corresponding to amino acid residues 1-58 of influenza A New Caledonia/20/1999 (H1) (SEQ ID NO:8). In one embodiment, the first amino acid sequence comprises at least 20 contiguous amino acid residues from a sequence at least 85%, at least 90%, at least 95% or at least 97% identical to a sequence selected from the group consisting of SEQ ID NO:20, SEQ ID NO: 35, SEQ ID NO:50 and SEQ ID NO:65. In one embodiment, the first amino acid sequence comprises at least 20 contiguous amino acid residues from a sequence selected from the group consisting of SEQ ID NO:20, SEQ ID NO: 35, SEQ ID NO:50 and SEQ ID NO:65.

In one embodiment, the first amino acid sequence comprises at least 40 contiguous amino acid residues from the amino acid region of an HA protein corresponding to amino acid residues 1-58 of influenza A New Caledonia/20/1999 (H1) (SEQ ID NO:8). In one embodiment, the first amino acid sequence comprises at least 40 contiguous amino acid residues from a sequence at least 85%, at least 90%, at least 95% or at least 97% identical to a sequence selected from the group consisting of SEQ ID NO:20, SEQ ID NO: 35, SEQ ID NO:50 and SEQ ID NO:65. In one embodiment, the first amino acid sequence comprises at least 40 contiguous amino acid residues from a sequence selected from the group consisting of SEQ ID NO:20, SEQ ID NO: 35, SEQ ID NO:50 and SEQ ID NO:65.

In one embodiment, the first amino acid sequence comprises a sequence at least 85%, at least 90%, at least 95% or at least 97% identical to a sequence selected from the group consisting of SEQ ID NO:20, SEQ ID NO: 35, SEQ ID NO:50 and SEQ ID NO:65. In one embodiment, the first amino acid sequence comprises a sequence selected from the group consisting of SEQ ID NO:20, SEQ ID NO: 35, SEQ ID NO:50 and SEQ ID NO:65.

In one embodiment, the second amino acid sequence is from the stem region of an HA protein from a virus selected from the group consisting of influenza A viruses, influenza B viruses and influenza C viruses. In one embodiment, the second amino acid sequence is from the stem region of an HA protein from a virus selected from the group consisting of an H1 influenza virus, an H2 influenza virus, an influenza H3 virus, an influenza H4 virus, an influenza H5 virus, an influenza H6 virus, an H7 influenza virus, an H8 influenza virus, an H9 influenza virus, an H10 influenza virus, an H11 influenza virus, an H12 influenza virus, an H13 influenza virus, an H14 influenza virus, an H15 influenza virus, an H16 influenza virus, an H17 influenza virus, and an H18 influenza virus. In one embodiment, the second amino acid sequence is from the stem region of an HA protein from a virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B). In one embodiment, the second amino acid sequence is from the stem region of an HA protein having an amino acid sequences at least 85%, at least 90%, at least 95% or at least 97% identical to a sequence selected from the group consisting of SEQ ID NO:8, SEQ ID NO:11, SEQ ID NO:14 and SEQ ID NO:17. In one embodiment, the second amino acid sequence is from the stem region of an HA protein comprising a sequence selected from the group consisting of SEQ ID NO:8, SEQ ID NO:11, SEQ ID NO:14 and SEQ ID NO:17.

As noted above, the second amino acid sequence comprises at least 20 contiguous amino acid residues from the amino acid sequence downstream of the carboxyl-terminal end of the head region sequence. According to the present invention, the term downstream refers to the entire amino acid sequence linked to the carboxyl-terminal amino acid residue of the head region. In one embodiment, the carboxyl-terminal end of the head region is located at the amino acid position corresponding to Cys291 of the HA protein of influenza A New Caledonia/20/1999 (H1) (SEQ ID NO:8) Thus, in one embodiment, the second amino acid sequence comprises at least 20 contiguous amino acids from the amino acid region of an HA protein corresponding to amino acid residues 292-517$_{[JCB1]}$ of influenza A New Caledonia/20/1999 (H1) (SEQ ID NO:8). In one embodiment, the second amino acid sequence comprises at least 20 contiguous amino acids from the amino acid region of an HA protein corresponding to amino acid residues 328$_{[JCB1]}$-517 of influenza A New Caledonia/20/1999 (H1) (SEQ ID NO:8). In one embodiment, the second amino acid sequence comprises at least 20 contiguous amino acid residues from a sequence at least 85%, at least 90%, at least 95% or at least 97% identical to a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77. In one embodiment, the second amino acid sequence comprises at least 20 contiguous amino acid residues from a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77.

In one embodiment, the second amino acid sequence comprises at least 40, at least 60, at least 75, at least 100, or at least 150 contiguous amino acids from the amino acid sequence downstream of the carboxyl-terminal end of the head region sequence. In one embodiment, the second amino acid sequence comprises at least 40, at least 60, at least 75, at least 100, or at least 150 contiguous amino acids from the amino acid region of an HA protein corresponding to amino acid residues 292-517 of influenza A New Caledonia/20/1999 (H1) (SEQ ID NO:8). In one embodiment, the second amino acid sequence comprises at least 40, at least 60, at least 75, at least 100, or at least 150 contiguous amino acids from the amino acid region of an HA protein corresponding to amino acid residues 328-517 of influenza A New Caledonia/20/1999 (H1) (SEQ ID NO:8). In one embodiment, the second amino acid sequence comprises at least 40, at least 60, at least 75, at least 100, or at least 150 contiguous amino acids from a sequence at least 85%, at least 90%, at least 95% or at least 97% identical to a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77. In one embodiment, the second amino acid sequence comprises at least 40, at least 60, at least 75, at least 100, or at least 150 contiguous amino acids from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77. In one embodiment, the second amino acid sequence comprises an amino acid sequence at least 85%, at least 90%, at least 95% or at least 97% identical to a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77. In one embodiment, the second amino acid sequence comprises a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77.

As noted above, the first and second amino acid sequences of the protein construct can be joined by a linker sequence. Any linker sequence can be used as long as the linker sequence has less than five contiguous amino acid residues from the head region of an HA protein and so long as the first and second amino acids are able to form the desired conformation. In one embodiment, the linker sequence is less than 10 amino acids, less than 7 amino acids or less than 5 amino acids in length. In one embodiment, the linker sequence comprises glycine and serine. In one embodiment, the linker sequence joins the carboxyl-terminal end of the first amino acid sequence to the amino-terminal end of the second amino acid sequence. In one embodiment, the linker sequence joins the carboxyl-terminal end of the second amino acid sequence to the amino-terminal end of the first amino acid sequence.

As noted above, either the first or second amino acid sequence of the protein construct is joined to at least a portion of a monomeric subunit protein such that the protein construct is capable of forming a nanoparticle. In one embodiment, the at least a portion of the monomeric subunit protein is joined to the second amino acid sequence. In a preferred embodiment, the at least a portion of the monomeric subunit protein is joined to the carboxyl end of the second amino acid sequence. In one embodiment, the portion comprises at least 50, at least 100 or at least 150 amino acids from a monomeric subunit. In one embodiment, the monomeric subunit is ferritin. In one embodiment, the monomeric subunit is lumazine synthase. In one embodiment, the portion comprises at least 50, at least 100 or at least 150 amino acids from SEQ ID NO:2, SEQ ID NO:5 or SEQ ID NO:194. In one embodiment, the monomeric subunit comprises a sequence at least 85% identical, at least 90% identical or at least 95% identical to SEQ ID NO:2, SEQ ID NO:5 or SEQ ID NO:194. In one embodiment, the monomeric subunit comprises a sequence selected from the group consisting of SEQ ID NO:2, SEQ ID NO:5 and SEQ ID NO:194.

The inventors have discovered that modification of the influenza HA sequences of the heretofore described protein constructs leads to improved stability of the protein construct. For example, the inventors have found that deletion from an HA protein of the amino acid region corresponding to amino acids N403-W435 of the HA protein of influenza A New Caledonia/20/1999 (H1) (SEQ ID NO:8) results in a more stable protein construct. Upon deletion of this region, the amino acid sequences flanking this region can be joined together directly, or they can be joined with a linker sequence such as, for example, glycine-serine-glycine Thus, in one embodiment, the second amino acid sequence comprises a polypeptide sequence at least 85%, at least 90% or at least 95% identical to at least 100 contiguous amino acid residues from the amino acid sequence downstream of the carboxyl-terminal end of the head region sequence, wherein the polypeptide sequence lacks a region corresponding to SEQ ID NO:133, SEQ ID NO:134, SEQ ID NO:135 or SEQ ID NO:136 from the HA protein of influenza A/New Caledonia 1999 (SEQ ID NO:8). In one embodiment, the second amino acid sequence comprises at least 100 contiguous amino acid residues from the amino acid sequence downstream of the carboxyl-terminal end of the head region sequence, wherein the polypeptide sequence lacks a region corresponding to SEQ ID NO:133, SEQ ID NO:134, SEQ ID NO:135 or SEQ ID NO:136 of the HA protein of influenza A/New Caledonia 1999 (SEQ ID NO:8).

In one embodiment, the second amino acid sequence comprises a polypeptide sequence at least 85%, at least 90% or at least 95% identical to at least 100 contiguous amino acid residues from the amino acid sequence downstream of the carboxyl-terminal end of the head region sequence, wherein the polypeptide sequence lacks a region corresponding to SEQ ID NO:137, SEQ ID NO:138, SEQ ID NO:139 or SEQ ID NO:140 of the HA protein of influenza A/California/4/2009 (SEQ ID NO:10). In one embodiment, the second amino acid sequence comprises at least 100 contiguous amino acid residues from the amino acid sequence downstream of the carboxyl-terminal end of the head region sequence, wherein the polypeptide sequence lacks a region corresponding to SEQ ID NO:137, SEQ ID NO:138, SEQ ID NO:139 or SEQ ID NO:140 of the HA protein of influenza A/California/4/2009 (SEQ ID NO:10).

In one embodiment, the second amino acid sequence comprises an amino acid sequence at least 85%, at least 90% or at least 95% identical to at least 100 contiguous amino acid residues from the amino acid sequence downstream of the carboxyl-terminal end of the head region sequence, wherein the polypeptide sequence lacks a region corresponding to SEQ ID NO:141, SEQ ID NO:142, SEQ ID NO:143 or SEQ ID NO:144 of the HA protein of influenza A/Singapore/1957 (SEQ ID NO:12). In one embodiment, the second amino acid sequence comprises an amino acid sequence at least 85%, at least 90% or at least 95% identical to at least 100 contiguous amino acid residues from the amino acid sequence downstream of the carboxyl-terminal end of the head region sequence, wherein the polypeptide sequence lacks a region corresponding to SEQ ID NO:141, SEQ ID NO:142, SEQ ID NO:143 or SEQ ID NO:144 of the HA protein of influenza A/Singapore/1957 (SEQ ID NO:12).

In one embodiment, the second amino acid sequence comprises at least 100 contiguous amino acid residues from the amino acid sequence downstream of the carboxyl-terminal end of the head region sequence, wherein the polypeptide sequence lacks a region corresponding to SEQ ID NO:145, SEQ ID NO:146, SEQ ID NO:147 or SEQ ID NO:148 of the HA protein of influenza A/Indonesia/05/2005 (H5) (SEQ ID NO:16). In one embodiment, the second amino acid sequence comprises at least 100 contiguous amino acid residues from the amino acid sequence downstream of the carboxyl-terminal end of the head region sequence, wherein the polypeptide sequence lacks a region corresponding to SEQ ID NO:145, SEQ ID NO:146, SEQ ID NO:147 or SEQ ID NO:148 of the HA protein of influenza A/Indonesia/05/2005 (H5) (SEQ ID NO:16).

In one embodiment, the second amino acid sequence comprises a sequence at least 85%, at least 90% or at least 95% identical to 100 contiguous amino acids from SEQ ID NO:23, SEQ ID NO:26 or SEQ ID NO:29, wherein the 100 contiguous amino acids do not comprise a sequence selected from the group consisting of SEQ ID NO:133, SEQ ID NO:134, SEQ ID NO:135 and SEQ ID NO:136. In one embodiment, the second amino acid sequence comprises 100 contiguous amino acids from SEQ ID NO:23, SEQ ID NO:26 or SEQ ID NO:29, wherein the 100 contiguous amino acids do not comprise a sequence selected from the group consisting of SEQ ID NO:133, SEQ ID NO:134, SEQ ID NO:135 and SEQ ID NO:136.

In one embodiment, the second amino acid sequence comprises a sequence at least 85%, at least 90% or at least 95% identical to 100 contiguous amino acids from SEQ ID NO:38, SEQ ID NO:41 or SEQ ID NO:44, wherein the 100 contiguous amino acids do not comprise a sequence selected from the group consisting of SEQ ID NO:137, SEQ ID NO:138, SEQ ID NO:139 and SEQ ID NO:140. In one embodiment, the second amino acid sequence comprises 100 contiguous amino acids from SEQ ID NO:38, SEQ ID NO:41 or SEQ ID NO:44, wherein the 100 contiguous amino acids do not comprise a sequence selected from the group consisting of SEQ ID NO:137, SEQ ID NO:138, SEQ ID NO:139 and SEQ ID NO:140.

In one embodiment, the second amino acid sequence comprises a sequence at least 85%, at least 90% or at least 95% identical to 100 contiguous amino acids from SEQ ID NO:53, SEQ ID NO:56 or SEQ ID NO:59, wherein the 100 contiguous amino acids do not comprise a sequence selected from the group consisting of SEQ ID NO:141, SEQ ID NO:142, SEQ ID NO:143 and SEQ ID NO:144. In one embodiment, the second amino acid sequence comprises 100 contiguous amino acids from SEQ ID NO:53, SEQ ID NO:56 or SEQ ID NO:59, wherein the 100 contiguous amino acids do not comprise a sequence selected from the group consisting of SEQ ID NO:141, SEQ ID NO:142, SEQ ID NO:143 and SEQ ID NO:144.

In one embodiment, the second amino acid sequence comprises a sequence at least 85%, at least 90% or at least 95% identical to 100 contiguous amino acids from SEQ ID NO:68, SEQ ID NO:71 or SEQ ID NO:74, wherein the 100 contiguous amino acids do not comprise a sequence selected from the group consisting of SEQ ID NO:145, SEQ ID NO:146, SEQ ID NO:147 and SEQ ID NO:148. In one embodiment, the second amino acid sequence comprises 100 contiguous amino acids from SEQ ID NO:68, SEQ ID NO:71 or SEQ ID NO:74, wherein the 100 contiguous amino acids do not comprise a sequence selected from the group consisting of SEQ ID NO:145, SEQ ID NO:146, SEQ ID NO:147 and SEQ ID NO:148.

In one embodiment, the second amino acid sequence comprises a sequence at least 85%, at least 90% or at least 95% identical to 100 contiguous amino acids from a sequence selected from the group consisting of SEQ ID NO:26, SEQ ID NO:28, SEQ ID NO:32, SEQ ID NO:41, SEQ ID NO:44, SEQ ID NO:47, SEQ ID NO:56, SEQ ID NO:59, SEQ ID NO:62, SEQ ID NO:71 and SEQ ID NO:77. In one embodiment, the second amino acid sequence comprises at least 100 contiguous amino acids from a sequence selected from the group consisting of SEQ ID NO:26, SEQ ID NO:32, SEQ ID NO:41, SEQ ID NO:47, SEQ ID NO:56, SEQ ID NO:62, SEQ ID NO:71 and SEQ ID NO:77. In one embodiment, the second amino acid sequence comprises a sequence selected from the group consisting of SEQ ID NO:26, SEQ ID NO:32, SEQ ID NO:41, SEQ ID NO:47, SEQ ID NO:56, SEQ ID NO:62, SEQ ID NO:71, SEQ ID NO:74 and SEQ ID NO:77

The inventors have also discovered that alteration of the sequence of the HA stem region sequence results in a more stable protein construct. For example, in the folded HA protein, the amino acid residues corresponding to K394 and E446 of influenza A New Caledonia/20/1999 (H1) (corresponding to K1 and E53 of SEQ ID NO:149) form a salt bridge, helping to stabilize the folded protein. The inventors have discovered that by substituting the lysine and glutamic acid residues with the appropriate amino acids, the interaction between the two amino acid residues can be strengthened, which improves the stability of the molecule and allows more extensive manipulation thereto. Thus, one embodiment of the present invention is a protein construct comprising a first amino acid sequence from the stem region of an influenza virus HA protein and a second amino acid sequence from the stem region of an influenza virus HA protein, the first and second amino acid sequences being covalently linked by a linker sequence, wherein the first amino acid sequence comprises at least 20 contiguous amino acid residues from the amino acid sequence upstream of the amino-terminal end of the head region sequence, wherein the second amino acid sequence comprises at least 60 contiguous amino acids from the amino acid sequence downstream of the carboxyl-terminal end of the head region sequence, wherein the 60 contiguous amino acids comprise a polypeptide sequence corresponding to the sequence of SEQ ID NO:149 or SEQ ID NO:150 from A/New Caledonia/20/1999, and wherein the amino acid residue in the polypeptide sequence that corresponds to K1 of SEQ ID NO:149 or K1 of SEQ ID NO:150 is substituted with an amino acid other than lysine, and the amino acid residue corresponding to E53 of SEQ ID NO:149 or E20 of SEQ ID NO:150 is substituted with an amino acid residue other than glutamic acid, such that the strength of the interaction between the substituted amino acid residues is greater than the strength of the interaction in the wild-type protein.

As noted above, the amino acid residues corresponding to K394 and E446 of influenza A New Caledonia/20/1999 (H1) form a salt bridge, which is a type of bond$_{[JCB3]}$. It is known in the art that other types of bonds between amino acids exist, the strength of which vary depending on the type of bond. Examples of such bonds include, but are not limited to, a hydrophobic bond and a hydrogen bond, both of which are generally$_{[JCB4]}$ stronger than a salt bridge. Thus, in one embodiment, the amino acid residue in the polypeptide corresponding to K1 of SEQ ID NO:149 or K1 of SEQ ID NO:150 and the amino acid residue in the polypeptide corresponding to E53 of SEQ ID NO:149 or E20 of SEQ ID NO:150 are altered so that they form a hydrogen bond in the final folded protein. In one embodiment, the amino acid residue in the polypeptide corresponding to K1 of SEQ ID NO:149 or K1 of SEQ ID NO:150 and the amino acid residue in the polypeptide corresponding to E53 of SEQ ID NO:149 or E20 of SEQ ID NO:150 are altered so that they form a hydrophobic bond in the final folded protein.

The amino acids corresponding to K1 of SEQ ID NO:149, K1 of SEQ ID NO:150, E53 of SEQ ID NO:149 or E20 of SEQ ID NO:150 can be substituted with any amino acid residue, as long as the resulting interaction between the two amino acids is stronger than the salt-bridge in the unaltered protein. Examples of substitutions that increase the strength of the interaction between the amino acids corresponding to K394 and E446 of influenza A New Caledonia/20/1999 (H1) (K1 and E53 of SEQ ID NO:149) include, but are not limited to:

wherein the amino acid residue in the polypeptide sequence that corresponds to
K1 of SEQ ID NO:149 is substituted with methionine, and the amino acid residue corresponding to E53 of SEQ ID NO:149 is substituted with a leucine;

wherein the amino acid residue in the polypeptide sequence that corresponds to
K1 of SEQ ID NO:149 is substituted with methionine, and the amino acid residue corresponding to E53 of SEQ ID NO:149 is substituted with a methionine;

wherein the amino acid residue in the polypeptide sequence that corresponds to
K1 of SEQ ID NO:149 is substituted with leucine, and the amino acid residue corresponding to E53 of SEQ ID NO:149 is substituted with a leucine;

wherein the amino acid residue in the polypeptide sequence that corresponds to
K1 of SEQ ID NO:149 is substituted with isoleucine, and the amino acid residue corresponding to E53 of SEQ ID NO:149 is substituted with a isoleucine;

wherein the amino acid residue in the polypeptide sequence that corresponds to
K1 of SEQ ID NO:149 is substituted with leucine, and the amino acid residue corresponding to E53 of SEQ ID NO:149 is substituted with an isoleucine;

wherein the amino acid residue in the polypeptide sequence that corresponds to
K1 of SEQ ID NO:149 is substituted with glutamine, and the amino acid residue corresponding to E53 of SEQ ID NO:149 is substituted with a glutamine.

In one embodiment, the first amino acid sequence is from the stem region of an HA protein from a virus selected from the group consisting of influenza A viruses, influenza B viruses and influenza C viruses. In one embodiment, the first amino acid sequence is from the stem region of an HA protein from a virus selected from the group consisting of an H1 influenza virus, an H2 influenza virus, an influenza H3 virus, an influenza H4 virus, an influenza H5 virus, an influenza H6 virus, an H7 influenza virus, an H8 influenza virus, an H9 influenza virus, an H10 influenza virus, an H11 influenza virus, an H12 influenza virus, an H13 influenza virus, an H14 influenza virus, an H15 influenza virus, an H16 influenza virus, an H17 influenza virus, and an H18 influenza virus. In one embodiment, the first amino acid sequence is from the stem region of an HA protein from a virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B). In one embodiment, the first amino acid sequence is from the stem region of an HA protein having an amino acid sequences at least 85%, at least 90%, at least 95% or at least 97% identical to a sequence selected from the group consisting of SEQ ID NO:8, SEQ ID NO:11, SEQ ID NO:14 and SEQ ID NO:17. In one embodiment, the first amino acid sequence is from the stem region of an HA protein comprising a sequence selected from the group consisting of SEQ ID NO:8, SEQ ID NO:11, SEQ ID NO:14 and SEQ ID NO:17.

In one embodiment, the second amino acid sequence is from the stem region of an HA protein from a virus selected from the group consisting of influenza A viruses, influenza B viruses and influenza C viruses. In one embodiment, the second amino acid sequence is from the stem region of an HA protein from a virus selected from the group consisting of an H1 influenza virus, an H2 influenza virus, an influenza H3 virus, an influenza H4 virus, an influenza H5 virus, an influenza H6 virus, an H7 influenza virus, an H8 influenza virus, an H9 influenza virus, an H10 influenza virus, an H11 influenza virus, an H12 influenza virus, an H13 influenza virus, an H14 influenza virus, an H15 influenza virus, an H16 influenza virus, an H17 influenza virus, and an H18 influenza virus. In one embodiment, the second amino acid sequence is from the stem region of an HA protein from a virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B). In one embodiment, the second amino acid sequence is from the stem region of an HA protein having an amino acid sequences at least 85%, at least 90%, at least 95% or at least 97% identical to a sequence selected from the group consisting of SEQ ID NO:8, SEQ ID NO:11, SEQ ID NO:14 and SEQ ID NO:17. In one embodiment, the second amino acid sequence is from the stem region of an HA protein comprising a sequence selected from the group consisting of SEQ ID NO:8, SEQ ID NO:11, SEQ ID NO:14 and SEQ ID NO:17.

In one embodiment, the first amino acid sequence comprises at least 20 contiguous amino acid residues from the region of an HA protein corresponding to amino acid residues 1-58 of influenza A New Caledonia/20/1999 (H1) (SEQ ID NO:8). In one embodiment, the first amino acid sequence comprises at least 20 contiguous amino acid residues from a sequence at least 85%, at least 90%, at least 95% or at least 97% identical to a sequence selected from the group consisting of SEQ ID NO:20, SEQ ID NO: 35, SEQ ID NO:50 and SEQ ID NO:65. In one embodiment, the first amino acid sequence comprises at least 20 contiguous amino acid residues from a sequence selected from the group consisting of SEQ ID NO:20, SEQ ID NO: 35, SEQ ID NO:50 and SEQ ID NO:65.

In one embodiment, the first amino acid sequence comprises at least 40 contiguous amino acid residues from the amino acid region of an HA protein corresponding to amino acid residues 1-58 of influenza A New Caledonia/20/1999 (H1) (SEQ ID NO:8). In one embodiment, the first amino acid sequence comprises at least 40 contiguous amino acid residues from a sequence at least 85%, at least 90%, at least 95% or at least 97% identical to a sequence selected from the group consisting of SEQ ID NO:20, SEQ ID NO: 35, SEQ ID NO:50 and SEQ ID NO:65. In one embodiment, the first amino acid sequence comprises at least 40 contiguous amino acid residues from a sequence selected from the group consisting of SEQ ID NO:20, SEQ ID NO: 35, SEQ ID NO:50 and SEQ ID NO:65. In one embodiment, the first amino acid sequence comprises a sequence at least 85%, at least 90% or at least 95% identical to a sequence selected from the group consisting of SEQ ID NO:20, SEQ ID NO: 35, SEQ ID NO:50 and SEQ ID NO:65. In one embodiment, the first amino acid sequence comprises a sequence selected from the group consisting of SEQ ID NO:20, SEQ ID NO: 35, SEQ ID NO:50 and SEQ ID NO:65.

In one embodiment, the second amino acid sequence is from the stem region of an HA protein from a virus selected from the group consisting of influenza A viruses, influenza B viruses and influenza C viruses. In one embodiment, the second amino acid sequence is from the stem region of an HA protein from a virus selected from the group consisting of an H1 influenza virus, an H2 influenza virus, an influenza H3 virus, an influenza H4 virus, an influenza H5 virus, an influenza H6 virus, an H7 influenza virus, an H8 influenza virus, an H9 influenza virus, an H10 influenza virus, an H11 influenza virus, an H12 influenza virus, an H13 influenza virus, an H14 influenza virus, an H15 influenza virus, an H16 influenza virus, an H17 influenza virus, and an H18 influenza virus. In one embodiment, the second amino acid sequence is from the stem region of an HA protein from a virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B). In one embodiment, the second amino acid sequence is from the stem region of an HA protein having an amino acid sequences at least 85%, at least 90%, at least 95% or at least 97% identical to a sequence selected from the group consisting of SEQ ID NO:8, SEQ ID NO:11, SEQ ID NO:14 and SEQ ID NO:17. In one embodiment, the second amino acid sequence is from the stem region of an HA protein comprising a sequence selected from the group consisting of SEQ ID NO:8, SEQ ID NO:11, SEQ ID NO:14 and SEQ ID NO:17.

In one embodiment, the at least 60 contiguous amino acids of the second amino acid sequence are from the amino acid region of an HA protein corresponding to amino acid residues 292-517 of influenza A New Caledonia/20/1999 (H1) (SEQ ID NO:8). In one embodiment, the at least 60 contiguous amino acids of the second amino acid sequence are from the amino acid region of an HA protein corresponding to amino acid residues 328-517 of influenza A New Caledonia/20/1999 (H1) (SEQ ID NO:8). In one embodiment, the at least 60 contiguous amino acids of the second amino acid sequence are from a sequence at least 85%, at least 90%, at least 95% or at least 97% identical to a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77. In one embodiment, the at least 60 contiguous amino acids of the second amino acid sequence are from a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77.

In one embodiment, the second amino acid sequence comprises at least 75, at least 100, at least 150 or at least 200 contiguous amino acids from the amino acid sequence downstream of the carboxyl-terminal end of the head region sequence, wherein the at least 75, at least 100, at least 150 or at least 200 contiguous amino acids comprise a polypeptide sequence corresponding to the sequence of SEQ ID NO:149 or SEQ ID NO:150 of H1N1 NC, and wherein the amino acid residue in the polypeptide sequence corresponding to K1 of SEQ ID NO:149 or K1 of SEQ ID NO:150, and the amino acid residue in the polypeptide sequence that corresponds to E53 of SEQ ID NO:149 or E20 of SEQ ID NO:150 have been substituted with amino acids other than lysine and glutamic acid, respectively, such that the strength of the interaction between the substituted amino acid residues is greater than the strength of the interaction in the wild-type protein. In one embodiment, the second amino acid sequence comprises at least 75, at least 100, at least 150 or at least 200 contiguous amino acids from the amino acid region of an HA protein corresponding to amino acid residues 292-517 of influenza A New Caledonia/20/1999 (H1) (SEQ ID NO:8), wherein the at least 75, at least 100, at least 150 or at least 200 contiguous amino acids comprise a polypeptide sequence corresponding to the sequence of SEQ ID NO:149 or SEQ ID NO:150 of H1N1 NC, and wherein the amino acid residue in the polypeptide sequence corresponding to K1 of SEQ ID NO:149 or K1 of SEQ ID NO:150, and the amino acid residue in the polypeptide sequence that corresponds to E53 of SEQ ID NO:149 or E20 of SEQ ID NO:150 have been substituted with amino acids other than lysine and glutamic acid, respectively, such that the strength of the interaction between the substituted amino acid residues is greater than the strength of the interaction in the wild-type protein. In one embodiment, the second amino acid sequence comprises at least 75, at least 100, at least 150 or at least 200 contiguous amino acids from the amino acid region of an HA protein corresponding to amino acid residues 328 [JCm]-517 of influenza A New Caledonia/20/1999 (H1) (SEQ ID NO:8), wherein the at least 75, at least 100, at least 150 or at least 200 contiguous amino acids comprise a polypeptide sequence corresponding to the sequence of SEQ ID NO:149 or SEQ ID NO:150 of H1N1 NC, and wherein the amino acid residue in the polypeptide sequence corresponding to K1 of SEQ ID NO:149 or K1 of SEQ ID NO:150, and the amino acid residue in the polypeptide sequence that corresponds to E53 of SEQ ID NO:149 or E20 of SEQ ID NO:150 have been substituted with amino acids other than lysine and glutamic acid, respectively, such that the strength of the interaction between the substituted amino acid residues is greater than the strength of the interaction in the wild-type protein. In one embodiment, the second amino acid sequence comprises at least 75, at least 100, at least 150 or at least 200 contiguous amino acids from a sequence at least 85%, at least 90%, at least 95% or at least 97% identical to a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77, wherein the at least 75, at least 100, at least 150 or at least 200 contiguous amino acids comprise a polypeptide sequence corresponding to the sequence of SEQ ID NO:149 or SEQ ID NO:150 of H1N1 NC, and wherein the amino acid residue in the polypeptide sequence corresponding to K1 of SEQ ID NO:149 or K1 of SEQ ID NO:150, and the amino acid residue in the polypeptide sequence that corresponds to E53 of SEQ ID NO:149 or E20 of SEQ ID NO:150 have been substituted with amino acids other than lysine and glutamic acid, respectively, such that the strength of the interaction between the substituted amino acid residues is greater than the strength of the interaction in the wild-type protein. In one embodiment, the second amino acid sequence comprises at least 75, at least 100, at least 150, or at least 200 contiguous amino acids from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77. wherein the at least 75, at least 100, at least 150 or at least 200 contiguous amino acids comprise a polypeptide sequence corresponding to the sequence of SEQ ID NO:149 or SEQ ID NO:150 of H1N1 NC, and wherein the amino acid residue in the polypeptide sequence corresponding to K1 of SEQ ID NO:149 or K1 of SEQ ID NO:150, and the amino acid residue in the polypeptide sequence that corresponds to E53 of SEQ ID NO:149 or E20 of SEQ ID NO:150 have been substituted with amino acids other than lysine and glutamic acid, respectively, such that the strength of the interaction between the substituted amino acid residues is greater than the strength of the interaction in the wild-type protein.

Protein constructs containing the specified site-specific mutations can be used to make nanoparticles of the present invention by joining them to monomeric subunits. Thus, in one embodiment, the protein construct containing the disclosed site-specific mutations (e.g., K1 of SEQ ID NO:149 or SEQ ID NO:150 and E53 of SEQ ID N0149 or E20 of SEQ ID NO:150) is joined to at least a portion of a monomeric subunit protein, wherein the portion of the monomeric subunit protein is capable of directing self-assembly of protein constructs. In one embodiment, the at least a portion of the monomeric subunit protein is joined to the second amino acid sequence. In a preferred embodiment, the at least a portion of the monomeric subunit protein is joined to the carboxyl end of the second amino acid sequence. In one embodiment, the portion comprises at least 50, at least 100 or at least 150 amino acids from a monomeric subunit. In one embodiment, the monomeric subunit is ferritin. In one embodiment, the monomeric subunit is lumazine synthase. In one embodiment, the monomeric subunit comprises a sequence at least 85% identical, at least 90% identical or at least 95% identical to SEQ ID NO:2, SEQ ID NO:5 or SEQ ID NO:194. In one embodiment, the monomeric subunit comprises a sequence selected from the group consisting of SEQ ID NO:2, SEQ ID NO:5 and SEQ ID NO:194.

While the modifications made to the HA proteins disclosed herein have been described as separate embodiments, it should be appreciated that all such modification may be contained in a single protein construct. For example, a protein construct could be made in which a first amino acid sequence is joined by a linker to a second amino acid sequence, wherein the second amino acid sequence comprises amino acid sequence from the region downstream of the carboxyl-terminal end of the head region but lacks the internal loop sequence represented by SEQ ID NOs:133-148, and wherein amino acids in the second amino acid sequence corresponding to K1 of SEQ ID NO:149 or K1 of SEQ ID NO:50 and E53 of SEQ ID NO:149 or E20 of SEQ ID NO:150 have been substituted with amino acids other than lysine and glutamic acid, respectively, in order to increase the strength of the interaction between these amino acid residues in the folded protein. Thus, one embodiment of the present invention is a protein construct comprising a first amino acid sequence from the stem region of an influenza virus HA protein and a second amino acid sequence from the stem region of an influenza virus HA protein, the first and second amino acid sequences being covalently linked by a linker sequence, wherein the first amino acid sequence comprises at least 20 contiguous amino acid residues from the amino acid sequence upstream of the amino-terminal end of the head region sequence;

wherein the second amino acid sequence comprises a polypeptide sequence at least 85%, at least 90% or at least 95% identical to at least 100 contiguous amino acid residues from the amino acid sequence downstream of the carboxyl-terminal end of the head region sequence, wherein the polypeptide sequence comprises a sequence corresponding to the sequence in influenza A New Caledonia/20/1999 (H1) represented by SEQ ID NO:150, the sequence in influenza A California/2009 (H1) represented by SEQ ID NO:152, the sequence in influenza A Singapore/1957 (H2) represented by SEQ ID NO:154, and the sequence in influenza A Indonesia/2005 H5) represented by SEQ ID NO:156; and, wherein the amino acid residue in the polypeptide sequence that corresponds to K1 of SEQ ID NO:150 has been substituted with an amino acid other than lysine and the amino acid residue corresponding to E20 of SEQ ID NO:150 has been substituted with an amino acid other than glutamic acid.

In one embodiment, the polypeptide comprises at least 100 contiguous amino acids from the amino acid sequence downstream of the carboxyl-terminal end of the head region sequence. In one embodiment, the at least 100 contiguous amino acids comprise SEQ ID NO:150. In one embodiment, the at least 100 contiguous amino acids comprise SEQ ID NO:152. In one embodiment, the at least 100 contiguous amino acids sequence comprise SEQ ID NO:154. In one embodiment, the at least 100 contiguous amino acids comprise SEQ ID NO:156. It should be appreciated that in the above-described constructs, when the internal loop region is removed, the respective ends of the remaining HA protein can be directly joined together. However, in some cases, such direct linkage may reduce the flexibility of the peptide backbone. Thus, in some cases, it may be beneficial to replace the internal loop region with a linker sequence. As an example, if a six amino acid linker sequence were inserted into SEQ ID NO:150, the final sequence may appear as follows: VNSVIEKMGSGGSGTYNAELLVLL.

Accordingly, in one embodiment, the polypeptide sequence of the protein construct comprises SEQ ID NO:150, into which is inserted a short linker sequence. In one embodiment, the polypeptide sequence of the protein construct comprises SEQ ID NO:152, into which is inserted a short linker sequence. In one embodiment, the polypeptide sequence of the protein construct comprises SEQ ID NO:154, into which is inserted a short linker sequence. In one embodiment, the polypeptide sequence of the protein construct comprises SEQ ID NO:156, into which is inserted a short linker sequence. In one embodiment, the linker is made from serine and glycine residues. In one embodiment, the linker is less than ten amino acids in length. In one embodiment, the linker is less than 5 amino acids in length. In one embodiment, the linker is less than three amino acids in length.

While the protein constructs described heretofore can be used to produce nanoparticles capable of generating an immune response against one or more influenza viruses, in some embodiments, it may be useful to engineer further mutations into the amino acid sequences of proteins of the present invention. For example, it may be useful to alter sites such as enzyme recognition sites or glycosylation sites in the monomeric subunit protein, the trimerization domain, or linker sequences, in order to give the protein beneficial properties (e.g., solubility, half-life, mask portions of the protein from immune surveillance). In this regard, it is known that the monomeric subunit of ferritin is not glycosylated naturally. However, it can be glycosylated if it is expressed as a secreted protein in mammalian or yeast cells. Thus, in one embodiment, potential N-linked glycosylation sites in the amino acid sequences from the monomeric ferritin subunit are mutated so that the mutated ferritin subunit sequences are no longer glycosylated at the mutated site. One such sequence of a mutated monomeric ferritin subunit is represented by SEQ ID NO:5.

Protein construct sequences can also be altered to include further useful mutations. For example, in some instances, it may be desirable to block the production of an immune response against certain amino acid sequences in the protein construct. This may be done by adding a glycosylation site near the site to be blocked such that the glycans sterically hinder the ability of the immune system to reach the blocked site. Thus, in one embodiment, the sequence of the protein construct has been altered to include one or more glycosylation sites. Examples of such sites include, but are not limited to, Asn-X-Ser, Asn-X-Thr and Asn-X-Cys. In some instances, the glycosylation site can be introduced into a linker sequence. Further examples of useful sites at which to introduce glycosylation sites include, but are not limited to, the amino acid corresponding to amino acids 45-47, or amino acids 370-372[JCB6] from the HA protein of influenza A New Caledonia/20/1999 (H1). Methods of introducing glycosylation sites are known to those skilled in the art.

The disclosure herein demonstrates that mutations at specific locations in the HA or monomeric subunit protein produce useful protein constructs and consequently nanoparticles of the present invention. Examples of useful locations in a ferritin protein at which to introduce mutations include an amino acid corresponding to an amino acid position selected from the group consisting of amino acid position 18, amino acid position 20 and amino acid position 68 of SEQ ID NO:2. Examples of useful locations at which to introduce mutations include an amino acid in the HA protein corresponding to an amino acid position selected from the group consisting of amino acid position 36, amino acid position 45, amino acid position 47, amino acid position 49, amino acid position 339, amino acid position 340, amino acid position 341, amino acid position 342, amino acid position 361, amino acid position 372, amino acid position 394, amino acid position 402, amino acid position 437, amino acid position 438, amino acid position 445, amino acid position 446, amino acid position 448, amino acid position 449, amino acid position 450 and amino acid position 452 of HA protein of influenza A New Caledonia/20/1999 (H1) (SEQ ID NO:8). Some examples of such mutations are listed in Table 2. In one embodiment, the HA portion of the protein construct comprises an isoleucine, or an amino acid residue having similar properties thereto, at the position corresponding to amino acid position 36 of HA protein of influenza A New Caledonia/20/1999 (H1). In one embodiment, the HA portion of the protein construct comprises an asparagine, or an amino acid residue having similar properties thereto, at the position corresponding to amino acid position 45 of HA protein of influenza A New Caledonia/20/1999 (H1). In one embodiment, the HA portion of the protein construct comprises a threonine, or an amino acid residue having similar properties thereto, at the position corresponding to amino acid position 47 of HA protein of influenza A New Caledonia/20/1999 (H1). In one embodiment, the HA portion of the protein construct comprises a tryptophan, or an amino acid residue having similar properties thereto, at the position corresponding to amino acid position 49 of HA protein of influenza A New Caledonia/20/1999 (H1). In one embodiment, the HA portion of the protein construct comprises an glutamine, or an amino acid residue having similar properties thereto, at the position corresponding to amino acid position 339 of HA protein of influenza A New Caledonia/20/1999 (H1). In one embodiment, the HA portion of the protein construct comprises an arginine, or an amino acid residue having similar properties thereto, at the position corresponding to amino acid position 340 of HA protein of influenza A New Caledonia/20/1999 (H1). In one embodiment, the HA portion of the protein construct comprises a glutamic acid, or an amino acid residue having similar properties thereto, at the position corresponding to amino acid position 341 of HA protein of influenza A New Caledonia/20/1999 (H1). In one embodiment, the HA portion of the protein construct comprises a threonine, or an amino acid residue having similar properties thereto, at the position corresponding to amino acid position 342 of HA protein of influenza A New Caledonia/20/1999 (H1). In one embodiment, the HA portion of the protein construct comprises a threonine, or an amino acid residue having similar properties thereto, at the position corresponding to amino acid position 372 of HA protein of influenza A New Caledonia/20/1999 (H1). In one embodiment, the HA portion of the protein construct comprises a methionine, an isoleucine, a leucine, a glutamine, or an amino acid residue having similar properties thereto, at the position corresponding to amino acid position 394 of HA protein of influenza A New Caledonia/20/1999 (H1). In one embodiment, the HA portion of the protein construct comprises an asparagine, a threonine, a glycine, an asparagine, or an amino acid residue having similar properties thereto, at the position corresponding to amino acid position 402 of HA protein of influenza A New Caledonia/20/1999 (H1). In one embodiment, the HA portion of the protein construct comprises an aspartic acid, or an amino acid residue having similar properties thereto, at the position corresponding to amino acid position 437 of HA protein of influenza A New Caledonia/20/1999 (H1). In one embodiment, the HA portion of the protein construct comprises a leucine, or an amino acid residue having similar properties thereto, at the position corresponding to amino acid position 438 of HA protein of influenza A New Caledonia/20/1999 (H1). In one embodiment, the HA portion of the protein construct comprises a leucine, a methionine, or an amino acid residue having similar properties thereto, at the position corresponding to amino acid position 445 of HA protein of influenza A New Caledonia/20/1999 (H1). In one embodiment, the HA portion of the protein construct comprises an isoleucine, a leucine, a methionine, a glutamine, or an amino acid residue having similar properties thereto, at the position corresponding to amino acid position 446 of HA protein of influenza A New Caledonia/20/1999 (H1). In one embodiment, the HA portion of the protein construct comprises a glutamine, or an amino acid residue having similar properties thereto, at the position corresponding to amino acid position 448 of HA protein of influenza A New Caledonia/20/1999 (H1). In one embodiment, the HA portion of the protein construct comprises a tryptophan, a phenylalanine, or an amino acid residue having similar properties thereto, at the position corresponding to amino acid position 449 of HA protein of influenza A New Caledonia/20/1999 (H1). In one embodiment, the HA portion of the protein construct comprises an alanine, or an amino acid residue having similar properties thereto, at the position corresponding to amino acid position 450 of HA protein of influenza A New Caledonia/20/1999 (H1). In one embodiment, the HA portion of the protein construct comprises a leucine, or an amino acid residue having similar properties thereto, at the position corresponding to amino acid position 452 of HA protein of influenza A New Caledonia/20/1999 (H1). In one embodiment, the HA portion of the protein construct lacks one or more amino acids corresponding to amino acids 515-517 of the HA protein of influenza A New Caledonia/20/1999 (H1).

One embodiment of the present invention is a protein construct comprising an amino acid sequence at least 85%, at least 90%, at least 95% or at least 97% identical to a sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400.

In one embodiment, the amino acid residue corresponding to K1 of SEQ ID NO:149 or K1 of SEQ ID NO:150 is substituted with an amino acid other than lysine, and the amino acid residue corresponding to E53 of SEQ ID NO:149 or E20 of SEQ ID NO:20 is substituted with an amino acid other than glutamic acid, such that the strength of the interaction between the substituted amino acids is increased in the folded protein.

One embodiment of the present invention is a protein construct comprising a sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400. In one embodiment, the protein construct is capable of forming a nanoparticle when linked to a monomeric subunit protein, wherein the nanoparticle is capable of eliciting an immune response against an influenza virus.

As has been discussed previously, protein constructs made from influenza HA protein can be used to make nanoparticles of the present invention by joining them to monomeric subunits. Thus, in one embodiment, the protein construct is joined to at least a portion of a monomeric subunit protein, wherein the portion of the monomeric subunit protein is capable of directing self-assembly of protein constructs. In one embodiment, the at least a portion of the monomeric subunit protein is joined to the second amino acid sequence. In a preferred embodiment, the at least a portion of the monomeric subunit protein is joined to the carboxyl end of the second amino acid sequence. In one embodiment, the portion comprises at least 50, at least 100 or at least 150 amino acids from a monomeric subunit. In one embodiment, the monomeric subunit is ferritin. In one embodiment, the monomeric subunit is lumazine synthase. In one embodiment, the monomeric subunit comprises a sequence at least 85% identical, at least 90% identical or at least 95% identical to SEQ ID NO:2, SEQ ID NO:5 or SEQ ID NO:194. In one embodiment, the monomeric subunit comprises a sequence selected from the group consisting of SEQ ID NO:2, SEQ ID NO:5 and SEQ ID NO:194.

One embodiment of the present invention is a protein construct comprising an amino acid sequence at least 85%, at least 90%, at least 95% or at least 97% identical to a sequence selected from the group consisting of SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:161, SEQ ID NO:167, SEQ ID NO:173, SEQ ID NO:179, SEQ ID NO:185, SEQ ID NO:191, SEQ ID NO:200, SEQ ID NO:206, SEQ ID NO:212, SEQ ID NO:215, SEQ ID NO:220, SEQ ID NO:223, SEQ ID NO:225, SEQ ID NO:227, SEQ ID NO:229, SEQ ID NO:231, SEQ ID NO:233, SEQ ID NO:238, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQQ ID NO:257, SEQ ID NO:259, SEQ ID NO:264, SEQ ID NO:271, SEQ ID NO:278, SEQ ID NO:285, SEQ ID NO:292, SEQ ID NO:299, SEQ ID NO:306, SEQ ID NO:313, SEQ ID NO:320, SEQ ID NO:327, SEQ ID NO:334, SEQ ID NO:341, SEQ ID NO:348, SEQ ID NO:355, SEQ ID NO:362, SEQ ID NO:369, SEQ ID NO:376, SEQ ID NO:383, SEQ ID NO:390 and SEQ ID NO:397. In one embodiment, the amino acid residue corresponding to K1 of SEQ ID NO:149 or K1 of SEQ ID NO:150 is substituted with an amino acid other than lysine, and the amino acid residue corresponding to E53 of SEQ ID NO:149 or E20 of SEQ ID NO:20 is substituted with an amino acid other than glutamic acid, such that the strength of the interaction between the substituted amino acids is increased in the folded protein. In one embodiment, the HA portion of the protein construct comprises an isoleucine, or an amino acid residue having similar properties thereto, at the position corresponding to amino acid position 36 of HA protein of influenza A New Caledonia/20/1999 (H1). In one embodiment, the HA portion of the protein construct comprises an asparagine, or an amino acid residue having similar properties thereto, at the position corresponding to amino acid position 45 of HA protein of influenza A New Caledonia/20/1999 (H1). In one embodiment, the HA portion of the protein construct comprises a threonine, or an amino acid residue having similar properties thereto, at the position corresponding to amino acid position 47 of HA protein of influenza A New Caledonia/20/1999 (H1). In one embodiment, the HA portion of the protein construct comprises a tryptophan, or an amino acid residue having similar properties thereto, at the position corresponding to amino acid position 49 of HA protein of influenza A New Caledonia/20/1999 (H1). In one embodiment, the HA portion of the protein construct comprises an glutamine, or an amino acid residue having similar properties thereto, at the position corresponding to amino acid position 339 of HA protein of influenza A New Caledonia/20/1999 (H1). In one embodiment, the HA portion of the protein construct comprises an arginine, or an amino acid residue having similar properties thereto, at the position corresponding to amino acid position 340 of HA protein of influenza A New Caledonia/20/1999 (H1). In one embodiment, the HA portion of the protein construct comprises a glutamic acid, or an amino acid residue having similar properties thereto, at the position corresponding to amino acid position 341 of HA protein of influenza A New Caledonia/20/1999 (H1). In one embodiment, the HA portion of the protein construct comprises a threonine, or an amino acid residue having similar properties thereto, at the position corresponding to amino acid position 342 of HA protein of influenza A New Caledonia/20/1999 (H1). In one embodiment, the HA portion of the protein construct comprises a threonine, or an amino acid residue having similar properties thereto, at the position corresponding to amino acid position 372 of HA protein of influenza A New Caledonia/20/1999 (H1). In one embodiment, the HA portion of the protein construct comprises a methionine, an isoleucine, a leucine, a glutamine, or an amino acid residue having similar properties thereto, at the position corresponding to amino acid position 394 of HA protein of influenza A New Caledonia/20/1999 (H1). In one embodiment, the HA portion of the protein construct comprises an asparagine, a threonine, a glycine, an asparagine, or an amino acid residue having similar properties thereto, at the position corresponding to amino acid position 402 of HA protein of influenza A New Caledonia/20/1999 (H1). In one embodiment, the HA portion of the protein construct comprises an aspartic acid, or an amino acid residue having similar properties thereto, at the position corresponding to amino acid position 437 of HA protein of influenza A New Caledonia/20/1999 (H1). In one embodiment, the HA portion of the protein construct comprises a leucine, or an amino acid residue having similar properties thereto, at the position corresponding to amino acid position 438 of HA protein of influenza A New Caledonia/20/1999 (H1). In one embodiment, the HA portion of the protein construct comprises a leucine, a methionine, or an amino acid residue having similar properties thereto, at the position corresponding to amino acid position 445 of HA protein of influenza A New Caledonia/20/1999 (H1). In one embodiment, the HA portion of the protein construct comprises an isoleucine, a leucine, a methionine, a glutamine, or an amino acid residue having similar properties thereto, at the position corresponding to amino acid position 446 of HA protein of influenza A New Caledonia/20/1999 (H1). In one embodiment, the HA portion of the protein construct comprises a glutamine, or an amino acid residue having similar properties thereto, at the position corresponding to amino acid position 448 of HA protein of influenza A New Caledonia/20/1999 (H1). In one embodiment, the HA portion of the protein construct comprises a tryptophan, a phenylalanine, or an amino acid residue having similar properties thereto, at the position corresponding to amino acid position 449 of HA protein of influenza A New Caledonia/20/1999 (H1). In one embodiment, the HA portion of the protein construct comprises an alanine, or an amino acid residue having similar properties thereto, at the position corresponding to amino acid position 450 of HA protein of influenza A New Caledonia/20/1999 (H1). In one embodiment, the HA portion of the protein construct comprises a leucine, or an amino acid residue having similar properties thereto, at the position corresponding to amino acid position 452 of HA protein of influenza A New Caledonia/20/1999 (H1). In one embodiment, the HA portion of the protein construct lacks one or more amino acids corresponding to amino acids 515-517 of the HA protein of influenza A New Caledonia/20/1999 (H1).

One embodiment of the present invention is a protein construct comprising a sequence selected from the group consisting of SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:161, SEQ ID NO:167, SEQ ID NO:173, SEQ ID NO:179, SEQ ID NO:185, SEQ ID NO:191, SEQ ID NO:200, SEQ ID NO:206, SEQ ID NO:212, SEQ ID NO:215, SEQ ID NO:220, SEQ ID NO:223, SEQ ID NO:225, SEQ ID NO:227, SEQ ID NO:229, SEQ ID NO:231, SEQ ID NO:233, SEQ ID NO:238, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQQ ID NO:257, SEQ ID NO:259, SEQ ID NO:264, SEQ ID NO:271, SEQ ID NO:278, SEQ ID NO:285, SEQ ID NO:292, SEQ ID NO:299, SEQ ID NO:306, SEQ ID NO:313, SEQ ID NO:320, SEQ ID NO:327, SEQ ID NO:334, SEQ ID NO:341, SEQ ID NO:348, SEQ ID NO:355, SEQ ID NO:362, SEQ ID NO:369, SEQ ID NO:376, SEQ ID NO:383, SEQ ID NO:390 and SEQ ID NO:397.

One embodiment of the present invention is a protein construct encoded by a nucleic acid molecule comprising a nucleic acid sequence at least 85%, at least 90%, at least 95% or at least 97% identical to a sequence selected from the group consisting of SEQ ID NO:266, SEQ ID NO:273, SEQ ID NO: SEQ ID NO:280, SEQ ID NO:287, SEQ ID NO:294, SEQ ID NO:301, SEQ ID NO:308, SEQ ID NO:315, SEQ ID NO:322, SEQ ID NO:329, SEQ ID NO:336, SEQ ID NO:343, SEQ ID NO:350, SEQ ID NO:357, SEQ ID NO:364, SEQ ID NO:371, SEQ ID NO:378, SEQ ID NO:385 SEQ ID NO:392 and SEQ ID NO:399. One embodiment of the present invention is a protein construct encoded by a nucleic acid molecule comprising a nucleic acid sequence selected from the group consisting of SEQ ID NO:266, SEQ ID NO:273, SEQ ID NO: SEQ ID NO:280, SEQ ID NO:287, SEQ ID NO:294, SEQ ID NO:301, SEQ ID NO:308, SEQ ID NO:315, SEQ ID NO:322, SEQ ID NO:329, SEQ ID NO:336, SEQ ID NO:343, SEQ ID NO:350, SEQ ID NO:357, SEQ ID NO:364, SEQ ID NO:371, SEQ ID NO:378, SEQ ID NO:385 SEQ ID NO:392 and SEQ ID NO:399.

Proteins and protein constructs of the present invention are encoded by nucleic acid molecules of the present invention. In addition, they are expressed by nucleic acid constructs of the present invention. As used herein a nucleic acid construct is a recombinant expression vector, i.e., a vector linked to a nucleic acid molecule encoding a protein such that the nucleic acid molecule can effect expression of the protein when the nucleic acid construct is administered to, for example, a subject or an organ, tissue or cell. The vector also enables transport of the nucleic acid molecule to a cell within an environment, such as, but not limited to, an organism, tissue, or cell culture. A nucleic acid construct of the present disclosure is produced by human intervention. The nucleic acid construct can be DNA, RNA or variants thereof. The vector can be a DNA plasmid, a viral vector, or other vector. In one embodiment, a vector can be a cytomegalovirus (CMV), retrovirus, adenovirus, adeno-associated virus, herpes virus, vaccinia virus, poliovirus, sindbis virus, or any other DNA or RNA virus vector. In one embodiment, a vector can be a pseudotyped lentiviral or retroviral vector. In one embodiment, a vector can be a DNA plasmid. In one embodiment, a vector can be a DNA plasmid comprising viral components and plasmid components to enable nucleic acid molecule delivery and expression. Methods for the construction of nucleic acid constructs of the present disclosure are well known. See, for example, Molecular Cloning: a Laboratory Manual, 3$^{rd}$ edition, Sambrook et al. 2001 Cold Spring Harbor Laboratory Press, and Current Protocols in Molecular Biology, Ausubel et al. eds., John Wiley & Sons, 1994. In one embodiment, the vector is a DNA plasmid, such as a CMV/R plasmid such as CMV/R or CMV/R 8 KB (also referred to herein as CMV/R 8 kb). Examples of CMV/R and CMV/R 8 kb are provided herein. CMV/R is also described in U.S. Pat. No. 7,094,598 B2, issued Aug. 22, 2006.

As used herein, a nucleic acid molecule comprises a nucleic acid sequence that encodes a protein construct of the present invention. A nucleic acid molecule can be produced recombinantly, synthetically, or by a combination of recombinant and synthetic procedures. A nucleic acid molecule of the disclosure can have a wild-type nucleic acid sequence or a codon-modified nucleic acid sequence to, for example, incorporate codons better recognized by the human translation system. In one embodiment, a nucleic acid molecule can be genetically-engineered to introduce, or eliminate, codons encoding different amino acids, such as to introduce codons that encode an N-linked glycosylation site. Methods to produce nucleic acid molecules of the disclosure are known in the art, particularly once the nucleic acid sequence is know. It is to be appreciated that a nucleic acid construct can comprise one nucleic acid molecule or more than one nucleic acid molecule. It is also to be appreciated that a nucleic acid molecule can encode one protein or more than one protein.

One embodiment is a nucleic acid molecule encoding an influenza HA protein comprising an amino acid sequence at least 80%, at least 85%, at least 90%, at least 92%, at least 94%, at least 96%, at least 98% or at least 99% identical to a sequence selected from the group consisting of SEQ ID NO:150, SEQ ID N0152, SEQ ID NO:154 and SEQ ID NO:156. One embodiment is a nucleic acid molecule encoding an influenza HA protein comprising an amino acid sequence selected from the group consisting of SEQ ID NO:150, SEQ ID N0152, SEQ ID NO:154 and SEQ ID NO:156.

In one embodiment the nucleic acid molecule encodes an influenza HA protein comprising an amino acid sequence at least 80%, at least 85%, at least 90%, at least 92%, at least 94%, at least 96%, at least 98% or at least 99% identical to a sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400. In one embodiment the nucleic acid molecule encodes an influenza HA protein copmrising an amino acid selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400.

One embodiment of the present invention is a nucleic acid molecule comprising a nucleic acid sequence comprising an amino acid sequence at least 80%, at least 85%, at least 90%, at least 92%, at least 94%, at least 96%, at least 98% or at least 99% identical to a sequence selected from the group consisting of SEQ ID NO:79, SEQ ID NO:82, SEQ ID NO:85, SEQ ID NO:88, SEQ ID NO:91, SEQ ID NO:94, SEQ ID NO:97, SEQ ID NO:100, SEQ ID NO:103, SEQ ID NO:157, SEQ ID NO:163, SEQ ID NO:169, SEQ ID NO:175, SEQ ID NO:181, SEQ ID NO:187, SEQ ID NO:196, SEQ ID NO:202, SEQ ID NO:208, SEQ ID NO:216, SEQ ID NO:234, SEQ ID NO:260, SEQ ID NO:267, SEQ ID NO:274, SEQ ID NO:281, SEQ ID NO:288, SEQ ID NO:295, SEQ ID NO:302, SEQ ID NO:309, SEQ ID NO:316, SEQ ID NO:323, SEQ ID NO:330, SEQ ID NO:337, SEQ ID NO:344, SEQ ID NO:351, SEQ ID NO:358, SEQ ID NO:365, SEQ ID NO:372, SEQ ID NO:379, SEQ ID NO:386 and SEQ ID NO:393. One embodiment of the present invention is a nucleic acid molecule comprising a nucleic acid sequence selected from the group consisting of SEQ ID NO:79, SEQ ID NO:82, SEQ ID NO:85, SEQ ID NO:88, SEQ ID NO:91, SEQ ID NO:94, SEQ ID NO:97, SEQ ID NO:100, SEQ ID NO:103, SEQ ID NO:157, SEQ ID NO:163, SEQ ID NO:169, SEQ ID NO:175, SEQ ID NO:181, SEQ ID NO:187, SEQ ID NO:196, SEQ ID NO:202, SEQ ID NO:208, SEQ ID NO:216, SEQ ID NO:234, SEQ ID NO:260, SEQ ID NO:267, SEQ ID NO:274, SEQ ID NO:281, SEQ ID NO:288, SEQ ID NO:295, SEQ ID NO:302, SEQ ID NO:309, SEQ ID NO:316, SEQ ID NO:323, SEQ ID NO:330, SEQ ID NO:337, SEQ ID NO:344, SEQ ID NO:351, SEQ ID NO:358, SEQ ID NO:365, SEQ ID NO:372, SEQ ID NO:379, SEQ ID NO:386 and SEQ ID NO:393.

Preferred nucleic acid molecules are those that encode a monomeric subunit, a HA protein, and/or a protein construct comprising a monomeric subunit protein joined to an influenza HA protein. Thus, one embodiment of the present invention is a nucleic acid molecule comprising a nucleic acid sequence encoding a protein that comprises a monomeric subunit of a ferritin protein joined to an influenza HA protein. In one embodiment, the monomeric subunit comprises an amino acid sequence at least 80%, at least 85%, at least 90%, at least 92%, at least 94%, at least 96%, at least 98% or at least 99% identical to a sequence selected from the group consisting of SEQ ID NO:2 and SEQ ID NO:5. In one embodiment, the monomeric subunit comprises an amino acid sequence selected from the group consisting of SEQ ID NO:2 and SEQ ID NO:5.

One embodiment of the present invention is a nucleic acid molecule comprising a nucleic acid sequence encoding a protein that comprises a monomeric subunit of lumazine synthase joined to an influenza HA protein. In one embodiment, the monomeric subunit comprises an amino acid sequence at least 80%, at least 85%, at least 90%, at least 92%, at least 94%, at least 96%, at least 98% or at least 99% identical to SEQ ID NO:194. In one embodiment, the monomeric subunit comprises SEQ ID NO:194.

One embodiment of the present invention is a nucleic acid molecule encoding a protein construct comprising an amino acid sequence at least 80%, at least 85%, at least 90%, at least 92%, at least 94%, at least 96%, at least 98% or at least 99% identical to a sequence selected from the group consisting of SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:161, SEQ ID NO:167, SEQ ID NO:173, SEQ ID NO:179, SEQ ID NO:185, SEQ ID NO:191, SEQ ID NO:200, SEQ ID NO:206, SEQ ID NO:212, SEQ ID NO:215, SEQ ID NO:220, SEQ ID NO:223, SEQ ID NO:225, SEQ ID NO:227, SEQ ID NO:229, SEQ ID NO:231, SEQ ID NO:233, SEQ ID NO:238, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:264, SEQ ID NO:271, SEQ ID NO:278, SEQ ID NO:285, SEQ ID NO:292, SEQ ID NO:299, SEQ ID NO:306, SEQ ID NO:313, SEQ ID NO:320, SEQ ID NO:327, SEQ ID NO:334, SEQ ID NO:341, SEQ ID NO:348, SEQ ID NO:355, SEQ ID NO:362, SEQ ID NO:369, SEQ ID NO:376, SEQ ID NO:383, SEQ ID NO:390 and SEQ ID NO:397. One embodiment of the resent invention is a nucleic acid molecule encoding a protein construct comprising a sequence selected from the group consisting of SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:161, SEQ ID NO:167, SEQ ID NO:173, SEQ ID NO:179, SEQ ID NO:185, SEQ ID NO:191, SEQ ID NO:200, SEQ ID NO:206, SEQ ID NO:212, SEQ ID NO:215, SEQ ID NO:220, SEQ ID NO:223, SEQ ID NO:225, SEQ ID NO:227, SEQ ID NO:229, SEQ ID NO:231, SEQ ID NO:233, SEQ ID NO:238, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQQ ID NO:257, SEQ ID NO:259, SEQ ID NO:264, SEQ ID NO:271, SEQ ID NO:278, SEQ ID NO:285, SEQ ID NO:292, SEQ ID NO:299, SEQ ID NO:306, SEQ ID NO:313, SEQ ID NO:320, SEQ ID NO:327, SEQ ID NO:334, SEQ ID NO:341, SEQ ID NO:348, SEQ ID NO:355, SEQ ID NO:362, SEQ ID NO:369, SEQ ID NO:376, SEQ ID NO:383, SEQ ID NO:390 and SEQ ID NO:397.

One embodiment of the present invention is a nucleic acid molecule comprising a nucleic acid sequence at least 80%, at least 85%, at least 90%, at least 92%, at least 94%, at least 96%, at least 98% or at least 99% identical to a sequence selected from the group consisting of SEQ ID NO:106, SEQ ID NO:109, SEQ ID NO:112, SEQ ID NO:115, SEQ ID NO:118, SEQ ID NO:121, SEQ ID NO:124, SEQ ID NO:127, SEQ ID NO:130, SEQ ID NO:160, SEQ ID NO:166, SEQ ID NO:172, SEQ ID NO:178, SEQ ID NO:184, SEQ ID NO:190, SEQ ID NO:199, SEQ ID NO:205, SEQ ID NO:211, SEQ ID NO:219, SEQ ID NO:237, SEQ ID NO:263, SEQ ID NO:270, SEQ ID NO:277, SEQ ID NO:284, SEQ ID NO:291, SEQ ID NO:298, SEQ ID NO:305, SEQ ID NO:312, SEQ ID NO:319, SEQ ID NO:326, SEQ ID NO:333, SEQ ID NO:340, SEQ ID NO:347, SEQ ID NO:354, SEQ ID NO:361, SEQ ID NO:368, SEQ ID NO:375, SEQ ID NO:382, SEQ ID NO:389 and SEQ ID NO:396. One embodiment of the present invention is a nucleic acid molecule comprising a nucleic acid sequence selected from the group consisting of SEQ ID NO:106, SEQ ID NO:109, SEQ ID NO:112, SEQ ID NO:115, SEQ ID NO:118, SEQ ID NO:121, SEQ ID NO:124, SEQ ID NO:127, SEQ ID NO:130, SEQ ID NO:160, SEQ ID NO:166, SEQ ID NO:172, SEQ ID NO:178, SEQ ID NO:184, SEQ ID NO:190, SEQ ID NO:199, SEQ ID NO:205, SEQ ID NO:211, SEQ ID NO:219, SEQ ID NO:237, SEQ ID NO:263, SEQ ID NO:270, SEQ ID NO:277, SEQ ID NO:284, SEQ ID NO:291, SEQ ID NO:298, SEQ ID NO:305, SEQ ID NO:312, SEQ ID NO:319, SEQ ID NO:326, SEQ ID NO:333, SEQ ID NO:340, SEQ ID NO:347, SEQ ID NO:354, SEQ ID NO:361, SEQ ID NO:368, SEQ ID NO:375, SEQ ID NO:382, SEQ ID NO:389 and SEQ ID NO:396.

Also encompassed by the present invention are expression systems for producing protein constructs of the present invention. In one embodiment, nucleic acid molecules of the present invention are operationally linked to a promoter. As used herein, operationally linked means that proteins encoded by the linked nucleic acid molecules can be expressed when the linked promoter is activated. Promoters useful for practicing the present invention are known to those skilled in the art. One embodiment of the present invention is a nucleic acid molecule comprising a nucleic acid sequence at least 85%, at least 90%, at least 95% or at least 97% identical to a sequence selected from the group consisting of SEQ ID NO:266, SEQ ID NO:273, SEQ ID NO: SEQ ID NO:280, SEQ ID NO:287, SEQ ID NO:294, SEQ ID NO:301, SEQ ID NO:308, SEQ ID NO:315, SEQ ID NO:322, SEQ ID NO:329, SEQ ID NO:336, SEQ ID NO:343, SEQ ID NO:350, SEQ ID NO:357, SEQ ID NO:364, SEQ ID NO:371, SEQ ID NO:378, SEQ ID NO:385 SEQ ID NO:392 and SEQ ID NO:399. One embodiment of the present invention is a nucleic acid molecule comprising a nucleic acid sequence selected from the group consisting of SEQ ID NO:266, SEQ ID NO:273, SEQ ID NO: SEQ ID NO:280, SEQ ID NO:287, SEQ ID NO:294, SEQ ID NO:301, SEQ ID NO:308, SEQ ID NO:315, SEQ ID NO:322, SEQ ID NO:329, SEQ ID NO:336, SEQ ID NO:343, SEQ ID NO:350, SEQ ID NO:357, SEQ ID NO:364, SEQ ID NO:371, SEQ ID NO:378, SEQ ID NO:385 SEQ ID NO:392 and SEQ ID NO:399.

One embodiment of the present invention is a recombinant cell comprising a nucleic acid molecule of the present invention. One embodiment of the present invention is a recombinant virus comprising a nucleic acid molecule of the present invention.

As indicated above, the recombinant production of the protein constructs of the present invention can be accomplished using any suitable conventional recombinant technology currently known in the field. For example, production of a nucleic acid molecule encoding a fusion protein can be carried out in *E. coli* using a nucleic acid molecule encoding a suitable monomeric subunit protein, such as the *helicobacter pylori* ferritin monomeric subunit, ad fusing it to a nucleic acid molecule encoding a suitable influenza protein disclosed herein. The construct may then be transformed into protein expression cells, grown to suitable size, and induced to produce the fusion protein.

As has been described, because protein constructs of the present invention comprise a monomeric subunit protein, they can self-assemble. According to the present invention, the supramolecule resulting from such self-assembly is referred to as an HA expressing, monomeric subunit-based nanoparticle. For ease of discussion, the HA expressing, monomeric subunit-based nanoparticle will simply be referred to as a, or the, nanoparticle (np). Nanoparticles of the present invention have similar structural characteristics as the nanoparticles of the monomeric protein from which they are made. For example, with regard to ferritin, a ferritin-based nanoparticle contains 24 subunits and has 432 symmetry. In the case of nanoparticles of the present invention, the subunits are the protein constructs comprising a monomeric subunit (e.g., ferritin, lumazine synthase, etc.) joined to an influenza HA protein. Such nanoparticles display at least a portion of the HA protein on their surface as HA trimers. In such a construction, the HA trimer is accessible to the immune system and thus can elicit an immune response. Thus, one embodiment of the present invention is a nanoparticle comprising a protein construct of the present invention, wherein the protein construct comprises amino acids from the stem region of an HA protein joined to a monomeric subunit protein. In one embodiment, the nanoparticle displays the HA protein on its surface as a HA trimer. In one embodiment, the influenza HA protein is capable of eliciting protective antibodies to an influenza virus.

In one embodiment of the present invention, the nanoparticle comprises a protein construct comprising a first amino acid sequence from the stem region of an influenza virus HA protein and a second amino acid sequence from the stem region of an influenza virus HA protein, the first and second amino acid sequences being covalently linked by a linker sequence,
wherein the first amino acid sequence comprises at least 20 contiguous amino acid residues from the amino acid sequence upstream of the amino-terminal end of the head region sequence;
wherein the second amino acid sequence comprises at least 20 contiguous amino acid residues from the amino acid sequence downstream of the carboxyl-terminal end of the head region sequence; and,
wherein the first or second amino acid sequence is joined to at least a portion of a monomeric subunit domain.

In one embodiment of the present invention, the nanoparticle comprises a protein construct comprising a first amino acid sequence from the stem region of an influenza virus HA protein and a second amino acid sequence from the stem region of an influenza virus HA protein, the first and second amino acid sequences being covalently linked by a linker sequence,
wherein the first amino acid sequence comprises at least 20 contiguous amino acid residues from the amino acid sequence upstream of the amino-terminal end of the head region sequence;
wherein the second amino acid sequence comprises a polypeptide sequence at least 85%, at least 90% or at least 95% identical to at least 100 contiguous amino acid residues from the amino acid sequence downstream of the carboxyl-terminal end of the head region sequence,
wherein the polypeptide sequence comprises a sequence corresponding to the sequence in influenza A New Caledonia/20/1999 (H1) represented by SEQ ID NO:150, the sequence in influenza A California/2009 (H1) represented by SEQ ID NO:152, the sequence in influenza A Singapore/1957 (H2) represented by SEQ ID NO:154, and the sequence in influenza A Indonesia/2005 H5) represented by SEQ ID NO:156; and,
wherein the first or second amino acid sequence is joined to a monomeric subunit protein.

In a further embodiment, the amino acid residue in the polypeptide sequence that corresponds to K1 of SEQ ID NO:150 has been substituted with an amino acid other than lysine and the amino acid residue corresponding to E20 of SEQ ID NO:150 has been substituted with an amino acid other than glutamic acid.

In one embodiment, additional mutations have been made in the monomeric subunit portion and/or the first and/or second amino acid sequences of the protein construct that makes up the nanoparticle. Examples of useful locations in a ferritin protein at which to introduce mutations include an amino acid corresponding to an amino acid position selected from the group consisting of amino acid position 18, amino acid position 20 and amino acid position 68 of SEQ ID NO:2. In one embodiment, the protein construct comprises a mutation at an amino acid position corresponding to an amino acid position selected from the group consisting of amino acid position 36, amino acid position 45, amino acid position 47, amino acid position 49, amino acid position 339, amino acid position 340, amino acid position 341, amino acid position 342, amino acid position 361, amino acid position 372, amino acid position 394, amino acid position 402, amino acid position 437, amino acid position 438, amino acid position 445, amino acid position 446, amino acid position 448, amino acid 449, amino acid position 450 and amino acid position 452 of HA protein of influenza A New Caledonia/20/1999 (H1) (SEQ ID NO:8). In one embodiment, the HA portion of the protein construct comprises an isoleucine, or an amino acid residue having similar properties thereto, at the position corresponding to amino acid position 36 of HA protein of influenza A New Caledonia/20/1999 (H1). In one embodiment, the HA portion of the protein construct comprises an asparagine, or an amino acid residue having similar properties thereto, at the position corresponding to amino acid position 45 of HA protein of influenza A New Caledonia/20/1999 (H1). In one embodiment, the HA portion of the protein construct comprises a threonine, or an amino acid residue having similar properties thereto, at the position corresponding to amino acid position 47 of HA protein of influenza A New Caledonia/20/1999 (H1). In one embodiment, the HA portion of the protein construct comprises a tryptophan, or an amino acid residue having similar properties thereto, at the position corresponding to amino acid position 49 of HA protein of influenza A New Caledonia/20/1999 (H1). In one embodiment, the HA portion of the protein construct comprises an glutamine, or an amino acid residue having similar properties thereto, at the position corresponding to amino acid position 339 of HA protein of influenza A New Caledonia/ 20/1999 (H1). In one embodiment, the HA portion of the protein construct comprises an arginine, or an amino acid residue having similar properties thereto, at the position corresponding to amino acid position 340 of HA protein of influenza A New Caledonia/20/1999 (H1). In one embodiment, the HA portion of the protein construct comprises a glutamic acid, or an amino acid residue having similar properties thereto, at the position corresponding to amino acid position 341 of HA protein of influenza A New Caledonia/20/1999 (H1). In one embodiment, the HA portion of the protein construct comprises a threonine, or an amino acid residue having similar properties thereto, at the position corresponding to amino acid position 342 of HA protein of influenza A New Caledonia/20/1999 (H1). In one embodiment, the HA portion of the protein construct comprises a threonine, or an amino acid residue having similar properties thereto, at the position corresponding to amino acid position 372 of HA protein of influenza A New Caledonia/20/1999 (H1). In one embodiment, the HA portion of the protein construct comprises a methionine, an isoleucine, a leucine, a glutamine, or an amino acid residue having similar properties thereto, at the position corresponding to amino acid position 394 of HA protein of influenza A New Caledonia/ 20/1999 (H1). In one embodiment, the HA portion of the protein construct comprises an asparagine, a threonine, a glycine, an asparagine, or an amino acid residue having similar properties thereto, at the position corresponding to amino acid position 402 of HA protein of influenza A New Caledonia/20/1999 (H1). In one embodiment, the HA portion of the protein construct comprises an aspartic acid, or an amino acid residue having similar properties thereto, at the position corresponding to amino acid position 437 of HA protein of influenza A New Caledonia/20/1999 (H1). In one embodiment, the HA portion of the protein construct comprises a leucine, or an amino acid residue having similar properties thereto, at the position corresponding to amino acid position 438 of HA protein of influenza A New Caledonia/20/1999 (H1). In one embodiment, the HA portion of the protein construct comprises a leucine, a methionine, or an amino acid residue having similar properties thereto, at the position corresponding to amino acid position 445 of HA protein of influenza A New Caledonia/20/1999 (H1). In one embodiment, the HA portion of the protein construct comprises an isoleucine, a leucine, a methionine, a glutamine, or an amino acid residue having similar properties thereto, at the position corresponding to amino acid position 446 of HA protein of influenza A New Caledonia/20/1999 (H1). In one embodiment, the HA portion of the protein construct comprises a glutamine, or an amino acid residue having similar properties thereto, at the position corresponding to amino acid position 448 of HA protein of influenza A New Caledonia/20/1999 (H1). In one embodiment, the HA portion of the protein construct comprises a tryptophan, a phenylalanine, or an amino acid residue having similar properties thereto, at the position corresponding to amino acid position 449 of HA protein of influenza A New Caledonia/20/1999 (H1). In one embodiment, the HA portion of the protein construct comprises an alanine, or an amino acid residue having similar properties thereto, at the position corresponding to amino acid position 450 of HA protein of influenza A New Caledonia/20/1999 (H1). In one embodiment, the HA portion of the protein construct comprises a leucine, or an amino acid residue having similar properties thereto, at the position corresponding to amino acid position 452 of HA protein of influenza A New Caledonia/20/1999 (H1). In one embodiment, the HA portion of the protein construct lacks one or more amino acids corresponding to amino acids 515-517 of the HA protein of influenza A New Caledonia/ 20/1999 (H1).

In one embodiment, a nanoparticle of the present invention comprises a monomeric subunit protein comprising at least 50 amino acids, at least 100 amino acids, or at least 150 amino acids from lumazine synthase. In one embodiment, the monomeric subunit protein comprises at least 50 amino acids, at least 100 amino acids, or at least 150 amino acids from an amino acid sequence selected from SEQ ID NO:194, and/or comprises an amino acid sequence at least 85%, at least 90%, at least 95%, at least 97% at least 99% identical to SEQ ID NO:194. In one embodiment, the monomeric subunit comprises SEQ ID NO:194.

In one embodiment, the monomeric subunit protein comprises at least 50 amino acids, at least 100 amino acids, or at least 150 amino acids from a ferritin protein. In one embodiment, the monomeric subunit protein comprises at least 50 amino acids, at least 100 amino acids, or at least 150 amino acids from an amino acid sequence selected from the group consisting of SEQ ID NO:2 and SEQ ID NO:5, and/or comprises an amino acid sequence at least 85%, at least 90%, at least 95%, at least 97% at least 99% identical to an amino acid sequence selected from the group consisting of SEQ ID NO:2 and SEQ ID NO:5. In one embodiment, the monomeric ferritin subunit comprises SEQ ID NO:2 or SEQ ID NO:5.

In one embodiment, the nanoparticle comprises a protein construct comprising a monomeric protein of the present invention joined to at least one immunogenic portion of an HA protein from a virus selected from the group consisting of influenza type A viruses, influenza type B viruses and influenza type C viruses. In one embodiment the protein construct comprises a monomeric protein of the present invention joined to at least one immunogenic portion of an HA protein selected from the group consisting of an H1 influenza virus HA protein, an H2 influenza virus HA protein, H3 influenza virus HA protein, an H4 influenza virus HA protein, an H5 influenza virus HA protein, an H6 influenza virus HA protein, an H7 virus influenza HA protein, an H8 influenza virus HA protein, an H9 influenza virus HA protein, an H10 influenza virus HA protein, an H11 influenza virus HA protein, an H12 influenza virus HA protein, an H13 influenza virus HA protein, an H14 influenza virus HA protein, an H15 influenza virus HA protein, an H16 influenza virus HA protein, an H17 influenza virus HA protein, and an H18 influenza virus HA protein. In, one embodiment the immunogenic portion comprises at least one epitope.

In one embodiment, the nanoparticle comprises a protein construct comprising a monomeric protein of the present invention joined to amino acid sequence at least about 80%, at least about 85%, at least about 90%, at least about 95%, at least about 97% or at least about 99% identical to a sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400, wherein the protein construct is capable of selectively binding anti-influenza antibodies. In one embodiment, the nanoparticle comprises a protein construct comprising a monomeric protein of the present invention joined to amino acid sequence selected from the group consisting of SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:158, SEQ ID NO:164, SEQ ID NO:170, SEQ ID NO:176, SEQ ID NO:182, SEQ ID NO:188, SEQ ID NO:197, SEQ ID NO:203, SEQ ID NO:209, SEQ ID NO:214, SEQ ID NO:217, SEQ ID NO:222, SEQ ID NO:224, SEQ ID NO:226, SEQ ID NO:228, SEQ ID NO:230, SEQ ID NO:232, SEQ ID NO:235, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:261, SEQ ID NO:268, SEQ ID NO:275, SEQ ID NO:282, SEQ ID NO:289, SEQ ID NO:296, SEQ ID NO:303, SEQ ID NO:310, SEQ ID NO:317, SEQ ID NO:324, SEQ ID NO:331, SEQ ID NO:338, SEQ ID NO:345, SEQ ID NO:352, SEQ ID NO:359, SEQ ID NO:366, SEQ ID NO:373, SEQ ID NO:380, SEQ ID NO:387, SEQ ID NO:394 and SEQ ID NO:400, wherein the protein construct is capable of selectively binding anti-influenza antibodies.

In one embodiment of the present invention, the nanoparticle comprises a protein construct comprising an amino acid sequence at least 80%, at least about 85%, at least about 90%, at least about 95%, at least about 97% or at least about 99% identical to a sequence selected from the group consisting of SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:161, SEQ ID NO:167, SEQ ID NO:173, SEQ ID NO:179, SEQ ID NO:185, SEQ ID NO:191, SEQ ID NO:200, SEQ ID NO:206, SEQ ID NO:212, SEQ ID NO:215, SEQ ID NO:220, SEQ ID NO:223, SEQ ID NO:225, SEQ ID NO:227, SEQ ID NO:229, SEQ ID NO:231, SEQ ID NO:233, SEQ ID NO:238, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQQ ID NO:257, SEQ ID NO:259, SEQ ID NO:264, SEQ ID NO:271, SEQ ID NO:278, SEQ ID NO:285, SEQ ID NO:292, SEQ ID NO:299, SEQ ID NO:306, SEQ ID NO:313, SEQ ID NO:320, SEQ ID NO:327, SEQ ID NO:334, SEQ ID NO:341, SEQ ID NO:348, SEQ ID NO:355, SEQ ID NO:362, SEQ ID NO:369, SEQ ID NO:376, SEQ ID NO:383, SEQ ID NO:390 and SEQ ID NO:397, wherein the protein construct is capable of selectively binding anti-influenza antibodies. In one embodiment of the present invention, the nanoparticle comprises a protein construct comprising an amino acid sequence selected from the group consisting of SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:161, SEQ ID NO:167, SEQ ID NO:173, SEQ ID NO:179, SEQ ID NO:185, SEQ ID NO:191, SEQ ID NO:200, SEQ ID NO:206, SEQ ID NO:212, SEQ ID NO:215, SEQ ID NO:220, SEQ ID NO:223, SEQ ID NO:225, SEQ ID NO:227, SEQ ID NO:229, SEQ ID NO:231, SEQ ID NO:233, SEQ ID NO:238, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQQ ID NO:257, SEQ ID NO:259, SEQ ID NO:264, SEQ ID NO:271, SEQ ID NO:278, SEQ ID NO:285, SEQ ID NO:292, SEQ ID NO:299, SEQ ID NO:306, SEQ ID NO:313, SEQ ID NO:320, SEQ ID NO:327, SEQ ID NO:334, SEQ ID NO:341, SEQ ID NO:348, SEQ ID NO:355, SEQ ID NO:362, SEQ ID NO:369, SEQ ID NO:376, SEQ ID NO:383, SEQ ID NO:390 and SEQ ID NO:397.

In one embodiment, a nanoparticle of the invention comprises a protein construct encoded by a nucleic acid molecule comprising a nucleic acid sequence at least 85%, at least 90%, at least 95% or at least 97% identical to a sequence selected from the group consisting of SEQ ID NO:266, SEQ ID NO:273, SEQ ID NO: SEQ ID NO:280, SEQ ID NO:287, SEQ ID NO:294, SEQ ID NO:301, SEQ ID NO:308, SEQ ID NO:315, SEQ ID NO:322, SEQ ID NO:329, SEQ ID NO:336, SEQ ID NO:343, SEQ ID NO:350, SEQ ID NO:357, SEQ ID NO:364, SEQ ID NO:371, SEQ ID NO:378, SEQ ID NO:385 SEQ ID NO:392 and SEQ ID NO:399. In one embodiment, a nanoparticle of the invention comprises a protein construct encoded by a nucleic acid molecule comprising a nucleic acid sequence selected from the group consisting of SEQ ID NO:266, SEQ ID NO:273, SEQ ID NO: SEQ ID NO:280, SEQ ID NO:287, SEQ ID NO:294, SEQ ID NO:301, SEQ ID NO:308, SEQ ID NO:315, SEQ ID NO:322, SEQ ID NO:329, SEQ ID NO:336, SEQ ID NO:343, SEQ ID NO:350, SEQ ID NO:357, SEQ ID NO:364, SEQ ID NO:371, SEQ ID NO:378, SEQ ID NO:385 SEQ ID NO:392 and SEQ ID NO:399.

Nanoparticles of the present invention can be used to elicit an immune response to influenza virus. One type of immune response is a B-cell response, which results in the production of antibodies against the antigen that elicited the immune response. Thus, in one embodiment that the nanoparticle elicits antibodies that bind to the stem region of influenza HA protein from a virus selected from the group consisting of influenza A viruses, influenza B viruses and influenza C viruses. One embodiment of the present invention is a nanoparticle that elicits antibodies that bind to the stem region of influenza HA protein selected from the group consisting of an H1 influenza virus HA protein, an H2 influenza virus HA protein, an influenza H3 virus HA protein, an influenza H4 virus HA protein, an influenza H5 virus HA protein, an H6 virus HA protein, an H7 influenza virus HA protein, an H8 influenza virus HA protein, an H9 influenza virus HA protein, an H10 influenza virus HA protein HA protein, an H11 influenza virus HA protein, an H12 influenza virus HA protein, an H13 influenza virus HA protein, an H14 influenza virus HA protein, an H15 influenza virus HA protein, an H16 influenza virus HA protein, an H17 influenza virus HA protein, and an H18 influenza virus HA protein. One embodiment of the present invention is a nanoparticle that elicits antibodies that bind to the stem region of influenza HA protein from a strain of virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B), and variants thereof.

While all antibodies are capable of binding to the antigen which elicited the immune response that resulted in antibody production, preferred antibodies are those that provide broad heterosubtypic protection against influenza virus. Thus, one embodiment of the present invention is a nanoparticle that elicits protective antibodies that bind to the stem region of influenza HA protein from a virus selected from the group consisting of influenza A viruses, influenza B viruses and influenza C viruses. One embodiment of the present invention is a protein that elicits protective antibodies that bind to the stem region of influenza HA protein selected from the group consisting of an H1 influenza virus HA protein, an H2 influenza virus HA protein, an influenza H3 virus HA protein, an influenza H4 virus HA protein, an influenza H5 virus HA protein, an influenza H6 virus HA protein, an H7 influenza virus HA protein, an H8 influenza virus HA protein, an H9 influenza virus HA protein, an H10 influenza virus HA protein HA protein, an H11 influenza virus HA protein, an H12 influenza virus HA protein, an H13 influenza virus HA protein, an H14 influenza virus HA protein, an H15 influenza virus HA protein, an H16 influenza virus HA protein, an H17 influenza virus HA protein, and an H18 influenza virus HA protein. One embodiment of the present invention is a nanoparticle that elicits antibodies against a virus selected from the group consisting of influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1) and B/Brisbane/60/2008 (2008 Bris, B). One embodiment of the present invention is a nanoparticle that elicits antibodies that bind to a protein comprising an amino acid sequence at least 80% identical to a sequence selected from the group consisting of SEQ ID NO:8, SEQ ID NO:11, SEQ ID NO:14 and SEQ ID NO:17. One embodiment of the present invention is a nanoparticle that elicits antibodies that bind to a protein comprising an amino acid sequence selected from the group consisting of SEQ ID NO:8, SEQ ID NO:11, SEQ ID NO:14 and SEQ ID NO:17.

Protective antibodies elicited by proteins of the present invention can protect against viral infections by affecting any step in the life cycle of the virus. For example, protective antibodies may prevent an influenza virus from attaching to a cell, entering a cell, releasing viral ribonucleoproteins into the cytoplasm, forming new viral particles in the infected cell and budding new viral particles from the infected host cell membrane. [JCB7] In one embodiment, protective antibodies elicited by proteins of the present invention prevent influenza virus from entering the host cell. In one embodiment, protective antibodies elicited by proteins of the present invention prevent fusion of viral membranes with endosomal membranes. In one embodiment, protective antibodies elicited by proteins of the present invention prevent release of ribonucleoproteins into the cytoplasm of the host cell. In one embodiment, protective antibodies elicited by proteins of the present invention prevent assembly of new virus in the infected host cell. In one embodiment, protective antibodies elicited by proteins of the present invention prevent release of newly formed virus from the infected host cell.

Because the amino acid sequence of the stem region of influenza virus is highly conserved, protective antibodies elicited by nanoparticles of the present invention may be broadly protective. That is, protective antibodies elicited by nanoparticles of the present invention may protect against influenza viruses of more than one type, subtype and/or strain, Thus, one embodiment of the present invention is a protein that elicits broadly protective antibodies that bind the stem region of influenza HA protein. One embodiment is a nanoparticle that elicits antibodies that bind the stem region of an HA protein from more than one type of influenza virus selected from the group consisting of influenza type A viruses, influenza type B viruses and influenza type C viruses. One embodiment is a nanoparticle that elicits antibodies that bind the stem region of an HA protein from more than one sub-type of influenza virus selected from the group consisting of an H1 influenza virus, an H2 influenza virus, an influenza H3 virus, an influenza H4 virus, an influenza H5 virus, an influenza H6 virus, an H7 influenza virus, an H8 influenza virus, an H9 influenza virus, an H10 influenza virus, an H11 influenza virus, an H12 influenza virus, an H13 influenza virus, an H14 influenza virus, an H15 influenza virus, an H16 influenza virus, an H17 influenza virus, and an H18 influenza virus. One embodiment is a nanoparticle that elicits antibodies that bind the stem region of an HA protein from more than strain of influenza virus. One embodiment of the present invention is a nanoparticle that elicits antibodies that bind more than one protein comprising an amino acid sequence at least 80% identical to a sequence selected from the group consisting of SEQ ID NO:8, SEQ ID NO:11, SEQ ID NO:14 and SEQ ID NO:17. One embodiment of the present invention is a nanoparticle that elicits antibodies that bind to more than one protein comprising an amino acid sequence selected from the group consisting of SEQ ID NO:8, SEQ ID NO:11, SEQ ID NO:14 and SEQ ID NO:17.

Because nanoparticles of the present invention can elicit an immune response to an influenza virus, they are useful as vaccines to protect individuals against infection by influenza virus. Thus, one embodiment of the present invention is a vaccine comprising a nanoparticle of the present invention. Vaccines of the present invention can also contain other components such as adjuvants, buffers and the like. Although any adjuvant can be used, preferred embodiments can contain: chemical adjuvants such as aluminum phosphate, benzyalkonium chloride, ubenimex, and QS21; genetic adjuvants such as the IL-2 gene or fragments thereof, the granulocyte macrophage colony-stimulating factor (GM-CSF) gene or fragments thereof, the IL-18 gene or fragments thereof, the chemokine (C-C motif) ligand 21 (CCL21) gene or fragments thereof, the IL-6 gene or fragments thereof, CpG, LPS, TLR agonists, and other immune stimulatory genes; protein adjuvants such IL-2 or fragments thereof, the granulocyte macrophage colony-stimulating factor (GM-CSF) or fragments thereof, IL-18 or fragments thereof, the chemokine (C-C motif) ligand 21 (CCL21) or fragments thereof, IL-6 or fragments thereof, CpG, LPS, TLR agonists and other immune stimulatory cytokines or fragments thereof; lipid adjuvants such as cationic liposomes, N3 (cationic lipid), monophosphoryl lipid A (MPL1); other adjuvants including cholera toxin, enterotoxin, Fms-like tyrosine kinase-3 ligand (Flt-3L), bupivacaine, marcaine, and levamisole.

One embodiment of the present invention is a nanoparticle vaccine that includes more than one influenza HA protein. Such a vaccine can include a combination of different influenza HA proteins, either on a single nanoparticle or as a mixture of nanoparticles, at least two of which have unique influenza HA proteins. A multivalent vaccine can comprise as many influenza HA proteins as necessary in order to result in production of the immune response necessary to protect against a desired breadth of virus strains. In one embodiment, the vaccine comprises an HA protein from at least two different influenza strains (bi-valent). In one embodiment, the vaccine comprises a HA protein from at least three different influenza strains (tri-valent). In one embodiment, the vaccine comprises an HA protein from at least four different influenza strains (tetra-valent). In one embodiment, the vaccine comprises an HA protein from at least five different influenza strains (penta-valent). In one embodiment, the vaccine comprises an HA protein from at least six different influenza strains (hexa-valent). In various embodiments, a vaccine comprises an HA protein from each of 7, 8, 9, or 10 different strains of influenza virus. An example of such a combination is a nanoparticle vaccine that comprises influenza A group 1 HA protein, an influenza A group 2 HA protein, and an influenza B HA protein. In one embodiment, the influenza HA proteins are H1 HA, H3 HA, and B HA. In one embodiment, the influenza HA proteins are those included in the 2011-2012 influenza vaccine. Another example of a multivalent vaccine is a nanoparticle vaccine that comprises HA proteins from four different influenza viruses. In one embodiment, the multivalent vaccine comprises HA proteins from influenza A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1) and B/Brisbane/60/2008 (2008 Bris, B).

One embodiment of the present invention is a method to vaccinate an individual against influenza virus, the method comprising administering a nanoparticle to an individual such that an immune response against influenza virus is produced in the individual, wherein the nanoparticle comprises a monomeric subunit protein joined to an influenza HA protein, and wherein the nanoparticle displays the influenza HA on its surface. In one embodiment, the nanoparticle is a monovalent nanoparticle. In one embodiment, the nanoparticle is multivalent nanoparticle. Another embodiment of the present invention is a method to vaccinate an individual against infection with influenza virus, the method comprising:

a) obtaining a nanoparticle comprising monomeric subunits, wherein the monomeric subunits are joined to an influenza hemagglutinin protein, and wherein the nanoparticle displays the influenza HA on its surface; and, b) administering the nanoparticle to an individual such that an immune response against an influenza virus is produced.

One embodiment of the present invention is a method to vaccinate an individual against influenza virus, the method comprising administering a vaccine of the embodiments to an individual such that an immune response against influenza virus is produced in the individual, wherein the vaccine comprises at least one nanoparticle comprising a monomeric subunit joined to an influenza HA protein, and wherein the nanoparticle displays the influenza HA on its surface. In one embodiment, the vaccine is a monovalent vaccine. In one embodiment, the vaccine is multivalent vaccine. Another embodiment of the present invention is a method to vaccinate an individual against infection with influenza virus, the method comprising:

a) obtaining a vaccine comprising at least one nanoparticle comprising a protein construct of the present invention, wherein the protein construct comprises a monomeric subunit protein joined to an influenza HA protein, and wherein the nanoparticle displays the influenza HA on its surface; and, b) administering the vaccine to an individual such that an immune response against an influenza virus is produced.

In one embodiment, the nanoparticle is a monovalent nanoparticle[BG8]. In one embodiment, the nanoparticle is multivalent nanoparticle.

In one embodiment, the nanoparticle [JCB9] has octahedral symmetry. In one embodiment, the influenza HA protein is capable of eliciting antibodies to an influenza virus. In one embodiment, the influenza HA protein is capable of eliciting broadly antibodies to an influenza virus. In preferred embodiments the elicited antibodies are protective antibodies. In a preferred embodiment, the elicited antibodies are broadly heterosubtypic protective.

Vaccines of the present invention can be used to vaccinate individuals using a prime/boost protocol. Such a protocol is described in U.S. Patent Publication No. 20110177122, which is incorporated herein by reference in its entirety. In such a protocol, a first vaccine composition may be administered to the individual (prime) and then after a period of time, a second vaccine composition may be administered to the individual (boost). Administration of the boosting composition is generally weeks or months after administration of the priming composition, preferably about 2-3 weeks or 4 weeks, or 8 weeks, or 16 weeks, or 20 weeks, or 24 weeks, or 28 weeks, or 32 weeks. In one embodiment, the boosting composition is formulated for administration about 1 week, or 2 weeks, or 3 weeks, or 4 weeks, or 5 weeks, or 6 weeks, or 7 weeks, or 8 weeks, or 9 weeks, or 16 weeks, or 20 weeks, or 24 weeks, or 28 weeks, or 32 weeks after administration of the priming composition The first and second vaccine compositions can be, but need not be, the same composition. Thus, in one embodiment of the present invention, the step of administering the vaccine comprises administering a first vaccine composition, and then at a later time, administering a second vaccine composition. In one embodiment, the first vaccine composition comprises a nanoparticle of the present invention. In one embodiment, the first vaccine composition comprises a nanoparticle comprising amino acid sequences from the HA protein of an influenza virus selected from the group consisting of A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B).

In one embodiment, the individual being vaccinated has been exposed to influenza virus. As used herein, the terms exposed, exposure, and the like, indicate the subject has come in contact with a person of animal that is known to be infected with an influenza virus. Vaccines of the present invention may be administered using techniques well known to those in the art. Techniques for formulation and administration may be found, for example, in "Remington's Pharmaceutical Sciences", 18th ed., 1990, Mack Publishing Co., Easton, Pa. Vaccines may be administered by means including, but not limited to, traditional syringes, needleless injection devices, or microprojectile bombardment gene guns. Suitable routes of administration include, but are not limited to, parenteral delivery, such as intramuscular, intradermal, subcutaneous, intramedullary injections, as well as, intrathecal, direct intraventricular, intravenous, intraperitoneal, intranasal, or intraocular injections, just to name a few. For injection, the compounds of one embodiment of the invention may be formulated in aqueous solutions, preferably in physiologically compatible buffers such as Hanks' solution, Ringer's solution, or physiological saline buffer.

In one embodiment, vaccines, or nanoparticles, of the present invention can be used to protect an individual against infection by heterologous influenza virus. That is, a vaccine made using HA protein from one strain of influenza virus is capable of protecting an individual against infection by different strains of influenza. For example, a vaccine made using HA protein from influenza A/New Caledonia/20/1999 (1999 NC, H1), can be used to protect an individual against infection by an influenza virus including, but not limited to A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 indo, H5), A/Perth/16/2009 (2009 Per, H3), and/or A/Brisbane/59/2007 (2007 Bris, H1).

In one embodiment, vaccines, or nanoparticles, of the present invention can be used to protect an individual against infection by an antigenically divergent influenza virus. Antigenically divergent refers to the tendency of a strain of influenza virus to mutate over time, thereby changing the amino acids that are displayed to the immune system. Such mutation over time is also referred to as antigenic drift. Thus, for example, a vaccine made using HA protein from a A/New Caledonia/20/1999 (1999 NC, H1) strain of influenza virus is capable of protecting an individual against infection by earlier, antigenically divergent New Caledonia strains of influenza, and by evolving (or diverging) influenza strains of the future.

Because nanoparticles of the present invention display HA proteins that are antigenically similar to an intact HA, they can be used in assays for detecting antibodies against influenza virus (anti-influenza antibodies).

Thus, one embodiment of the present invention is a method for detecting anti-influenza virus antibodies using nanoparticles of the present invention. A detection method of the present invention can generally be accomplished by:

a. contacting at least a portion of a sample being tested for the presence of anti-influenza antibodies with a nanoparticle of the present invention; and, b. detecting the presence of a nanoparticle/antibody complex;

wherein the presence of a nanoparticle/antibody complex indicates that the sample contains anti-influenza antibodies.

In one embodiment of the present invention, a sample is obtained, or collected, from an individual to be tested for the presence of anti-influenza virus antibodies. The individual may or may not be suspected of having anti-influenza antibodies or of having been exposed to influenza virus. A sample is any specimen obtained from the individual that can be used to test for the presence of anti-influenza virus antibodies. A preferred sample is a body fluid that can be used to detect the presence of anti-influenza virus antibodies. Examples of body fluids that may be used to practice the present method include, but are not limited to, blood, plasma, serum, lacrimal fluid and saliva. Those skilled in the art can readily identify samples appropriate for practicing the disclosed methods.

Blood, or blood-derived fluids such as plasma, serum, and the like, are particularly suitable as the sample. Such samples can be collected and prepared from individuals using methods known in the art. The sample may be refrigerated or frozen before assay.

Any nanoparticle of the present invention can be used to practice the disclosed method as long as the nanoparticle binds to anti-influenza virus antibodies. Useful nanoparticles, and methods of their production, have been described in detail herein. In a preferred embodiment, the nanoparticle comprises a protein construct, wherein the protein construct comprises at least 25, at least 50, at least 75, at least 100, or at least 150 contiguous amino acids from a monomeric subunit protein joined to (fused to) at least one epitope from an influenza HA protein such that the nanoparticle comprises trimers of the influenza virus HA protein epitope on its surface, and wherein the protein construct is capable of self-assembling into nanoparticles.

As used herein, the term contacting refers to the introduction of a sample being tested for the presence of anti-influenza antibodies to a nanoparticle of the present invention, for example, by combining or mixing the sample and the nanoparticle of the present invention, such that the nanoparticle is able to come into physical contact with antibodies in the sample, if present. When anti-influenza virus antibodies are present in the sample, an antibody/nanoparticle complex is then formed. Such complex formation refers to the ability of an anti-influenza virus antibodies to selectively bind to the HA portion of the protein construct in the nanoparticle in order to form a stable complex that can be detected. Binding of anti-influenza virus antibodies in the sample to the nanoparticle is accomplished under conditions suitable to form a complex. Such conditions (e.g., appropriate concentrations, buffers, temperatures, reaction times) as well as methods to optimize such conditions are known to those skilled in the art. Binding can be measured using a variety of methods standard in the art including, but not limited to, agglutination assays, precipitation assays, enzyme immunoassays (e.g., ELISA), immunoprecipitation assays, immunoblot assays and other immunoassays as described, for example, in Sambrook et al., Molecular Cloning: A Laboratory Manual, (Cold Spring Harbor Labs Press, 1989), and Harlow et al., Antibodies, a Laboratory Manual (Cold Spring Harbor Labs Press, 1988), both of which are incorporated by reference herein in their entirety. These references also provide examples of complex formation conditions.

As used herein, the phrases selectively binds HA, selective binding to HA, and the like, refer to the ability of an antibody to preferentially bind a HA protein as opposed to binding proteins unrelated to HA, or non-protein components in the sample or assay. An antibody that selectively binds HA is one that binds HA but does not significantly bind other molecules or components that may be present in the sample or assay. Significant binding, is considered, for example, binding of an anti-HA antibody to a non-HA molecule with an affinity or avidity great enough to interfere with the ability of the assay to detect and/or determine the level of, anti-influenza antibodies in the sample. Examples of other molecules and compounds that may be present in the sample, or the assay, include, but are not limited to, non-HA proteins, such as albumin, lipids and carbohydrates.

In one embodiment, an anti-influenza virus antibody/nanoparticle complex, also referred to herein as an antibody/nanoparticle complex, can be formed in solution. In one embodiment an antibody/nanoparticle complex can be formed in which the nanoparticle is immobilized on (e.g., coated onto) a substrate. Immobilization techniques are known to those skilled in the art. Suitable substrate materials include, but are not limited to, plastic, glass, gel, celluloid, fabric, paper, and particulate materials. Examples of substrate materials include, but are not limited to, latex, polystyrene, nylon, nitrocellulose, agarose, cotton, PVDF (polyvinylidene-fluoride), and magnetic resin. Suitable shapes for substrate material include, but are not limited to, a well (e.g., microtiter dish well), a microtiter plate, a dipstick, a strip, a bead, a lateral flow apparatus, a membrane, a filter, a tube, a dish, a celluloid-type matrix, a magnetic particle, and other particulates. Particularly preferred substrates include, for example, an ELISA plate, a dipstick, an immunodot strip, a radioimmunoassay plate, an agarose bead, a plastic bead, a latex bead, a cotton thread, a plastic chip, an immunoblot membrane, an immunoblot paper and a flow-through membrane. In one embodiment, a substrate, such as a particulate, can include a detectable marker. For descriptions of examples of substrate materials, see, for example, Kemeny, D. M. (1991) A Practical Guide to ELISA, Pergamon Press, Elmsford, N.Y. pp 33-44, and Price, C. and Newman, D. eds. Principles and Practice of Immunoassay, 2nd edition (1997) Stockton Press, NY, N.Y., both of which are incorporated herein by reference in their entirety.

In accordance with the present invention, once formed, an anti-influenza virus antibody/nanoparticle complex is detected. Detection can be qualitative, quantitative, or semi-quantitative. As used herein, the phrases detecting complex formation, detecting the complex, and the like, refer to identifying the presence of anti-influenza virus antibody complexed with the nanoparticle. If complexes are formed, the amount of complexes formed can, but need not be, quantified. Complex formation, or selective binding, between a putative anti-influenza virus antibody and a nanoparticle can be measured (i.e., detected, determined) using a variety of methods standard in the art (see, for example, Sambrook et al. supra.), examples of which are disclosed herein. A complex can be detected in a variety of ways including, but not limited to use of one or more of the following assays: a hemagglutination inhibition assay, a radial diffusion assay, an enzyme-linked immunoassay, a competitive enzyme-linked immunoassay, a radioimmunoassay, a fluorescence immunoassay, a chemiluminescent assay, a lateral flow assay, a flow-through assay, a particulate-based assay (e.g., using particulates such as, but not limited to, magnetic particles or plastic polymers, such as latex or polystyrene beads), an immunoprecipitation assay, a BioCoreJ assay (e.g., using colloidal gold), an immunodot assay (e.g., CMG=s Immunodot System, Fribourg, Switzerland), and an immunoblot assay (e.g., a western blot), an phosphorescence assay, a flow-through assay, a chromatography assay, a PAGe-based assay, a surface plasmon resonance assay, a spectrophotometric assay, and an electronic sensory assay. Such assays are well known to those skilled in the art.

Assays can be used to give qualitative or quantitative results depending on how they are used. Some assays, such as agglutination, particulate separation, and precipitation assays, can be observed visually (e.g., either by eye or by a machines, such as a densitometer or spectrophotometer) without the need for a detectable marker.

In other assays, conjugation (i.e., attachment) of a detectable marker to the nanoparticle, or to a reagent that selectively binds to the nanoparticle, aids in detecting complex formation. A detectable marker can be conjugated to the nanoparticle, or nanoparticle-binding reagent, at a site that does not interfere with ability of the nanoparticle to bind to an anti-influenza virus antibody. Methods of conjugation are known to those of skill in the art. Examples of detectable markers include, but are not limited to, a radioactive label, a fluorescent label, a chemiluminescent label, a chromophoric label, an enzyme label, a phosphorescent label, an electronic label; a metal sol label, a colored bead, a physical label, or a ligand. A ligand refers to a molecule that binds selectively to another molecule. Preferred detectable markers include, but are not limited to, fluorescein, a radioisotope, a phosphatase (e.g., alkaline phosphatase), biotin, avidin, a peroxidase (e.g., horseradish peroxidase), beta-galactosidase, and biotin-related compounds or avidin-related compounds (e.g., streptavidin or ImmunoPure7 NeutrAvidin).

In one embodiment, an antibody/nanoparticle complex can be detected by contacting a sample with a specific compound, such as an antibody, that binds to an anti-influenza antibody, ferritin, or to the antibody/nanoparticle complex, conjugated to a detectable marker. A detectable marker can be conjugated to the specific compound in such a manner as not to block the ability of the compound to bind to the complex being detected. Preferred detectable markers include, but are not limited to, fluorescein, a radioisotope, a phosphatase (e.g., alkaline phosphatase), biotin, avidin, a peroxidase (e.g., horseradish peroxidase), beta-galactosidase, and biotin-related compounds or avidin-related compounds (e.g., streptavidin or ImmunoPure7 NeutrAvidin).

In another embodiment, a complex is detected by contacting the complex with an indicator molecule. Suitable indicator molecules include molecules that can bind to the anti-influenza virus antibody/nanoparticle complex, the anti-influenza virus antibody, or the nanoparticle. As such, an indicator molecule can comprise, for example, a reagent that binds the anti-influenza virus antibody, such as an antibody that recognizes immunoglobulins. Preferred indicator molecules that are antibodies include, for example, antibodies reactive with the antibodies from species of individual in which the anti-influenza virus antibodies are produced. An indicator molecule itself can be attached to a detectable marker of the present invention. For example, an antibody can be conjugated to biotin, horseradish peroxidase, alkaline phosphatase or fluorescein.

The present invention can further comprise one or more layers and/or types of secondary molecules or other binding molecules capable of detecting the presence of an indicator molecule. For example, an untagged (i.e., not conjugated to a detectable marker) secondary antibody that selectively binds to an indicator molecule can be bound to a tagged (i.e., conjugated to a detectable marker) tertiary antibody that selectively binds to the secondary antibody. Suitable secondary antibodies, tertiary antibodies and other secondary or tertiary molecules can be readily selected by those skilled in the art. Preferred tertiary molecules can also be selected by those skilled in the art based upon the characteristics of the secondary molecule. The same strategy can be applied for subsequent layers.

Preferably, the indicator molecule is conjugated to a detectable marker. A developing agent is added, if required, and the substrate is submitted to a detection device for analysis. In some protocols, washing steps are added after one or both complex formation steps in order to remove excess reagents. If such steps are used, they involve conditions known to those skilled in the art such that excess reagents are removed but the complex is retained.

Because assays of the present invention can detect anti-influenza virus antibodies [JCB10] in a sample, including a blood sample, such assays can be used to identify individuals having anti-influenza antibodies. Thus, one embodiment of the present invention is a method to identify an individual having anti-influenza virus antibodies, the method comprising:
 a. contacting a sample from an individual being tested for anti-influenza antibodies with a nanoparticle of the present invention; and,
 b. analyzing the contacted sample for the presence of a nanoparticle/antibody complex
 wherein the presence of a nanoparticle/antibody complex indicates the individual has anti-influenza antibodies.

Any of the disclosed assay formats can be used to conduct the disclosed method. Examples of useful assay formats include, but are not limited to, a radial diffusion assay, an enzyme-linked immunoassay, a competitive enzyme-linked immunoassay, a radioimmunoassay, a fluorescence immunoassay, a chemiluminescent assay, a lateral flow assay, a flow-through assay, a particulate-based assay (e.g., using particulates such as, but not limited to, magnetic particles or plastic polymers, such as latex or polystyrene beads), an immunoprecipitation assay, a BioCoreJ assay (e.g., using colloidal gold), an immunodot assay (e.g., CMG=s Immunodot System, Fribourg, Switzerland), and an immunoblot assay (e.g., a western blot), an phosphorescence assay, a flow-through assay, a chromatography assay, a PAGe-based assay, a surface plasmon resonance assay, biolayer interferometry assay, a spectrophotometric assay, and an electronic sensory assay.

If no anti-influenza antibodies are detected in the sample, such a result indicates the individual does not have anti-influenza virus antibodies. The individual being tested may or may not be suspected of having antibodies to influenza virus. The disclosed methods may also be used to determine if an individual has been exposed to one or more specific type, group, sub-group or strain of influenza virus. To make such a determination, a sample is obtained from an individual that has tested negative for antibodies (i.e., lacked antibodies) to one or more specific type, group, sub-group or strain of influenza virus sometime in their past (e.g., greater than about 1 year, greater than about 2 years, greater than about 3 years, greater than about 4 years, greater than about 5 years, etc.). The sample is then tested for the presence of anti-influenza virus antibodies to one or more type, group, sub-group or strain, of influenza virus using a nanoparticle-based assay of the present invention. If the assay indicates the presence of such antibodies, the individual is then identified as having been exposed to one or more type, group sub-group or strain, of influenza virus sometime after the test identifying them as negative for anti-influenza antibodies. Thus, one embodiment of the present invention is method to identify an individual that has been exposed to influenza virus, the method comprising:
 a. contacting at least a portion of a sample from an individual being tested for anti-influenza antibodies with a nanoparticle of the present invention; and,
 b. analyzing the contacted sample for the presence or level of a antibody/nanoparticle complex, wherein the presence or level of antibody/nanoparticle complex indicates the presence or level of recent anti-influenza antibodies;
 c. comparing the recent anti-influenza antibody level with a past anti-influenza antibody level;
 wherein an increase in the recent anti-influenza antibody level over the past anti-influenza antibody level indicates the individual has been exposed to influenza virus subsequent to determination of the past anti-influenza antibody level.

Methods of the present invention are also useful for determining the response of an individual to a vaccine. Thus, one embodiment is a method for measuring the response of an individual to an influenza vaccine, the method comprising:
 a. administering to the individual a vaccine for influenza virus;
 b. contacting at least a portion of a sample from the individual with a nanoparticle of the present invention;
 c. analyzing the contacted sample for the presence or level of a antibody/nanoparticle complex, wherein the presence or level of antibody/nanoparticle complex indicates the presence or level of recent anti-influenza antibodies
 wherein an increase in the level of antibody in the sample over the pre-vaccination level of antibody in the individual indicates the vaccine induced an immune response in the individual.

The influenza vaccine administered to the individual may, but need not, comprise a vaccine of the present invention, as long as the nanoparticle comprises an HA protein that can bind an anti-influenza antibody induced by the administered vaccine. Methods of administering influenza vaccines are known to those of skill in the art.

Analysis of the sample obtained from the individual may be performed using any of the disclosed assay formats. In one embodiment, analysis of the sample is performed using an assay format selected from the group consisting of, a radial diffusion assay, an enzyme-linked immunoassay, a competitive enzyme-linked immunoassay, a radioimmunoassay, a fluorescence immunoassay, a chemiluminescent assay, a lateral flow assay, a flow-through assay, a particulate-based assay (e.g., using particulates such as, but not limited to, magnetic particles or plastic polymers, such as latex or polystyrene beads), an immunoprecipitation assay, a BioCoreJ assay (e.g., using colloidal gold), an immunodot assay (e.g., CMG=s Immunodot System, Fribourg, Switzerland), and an immunoblot assay (e.g., a western blot), an phosphorescence assay, a flow-through assay, a chromatography assay, a PAGE-based assay, a surface plasmon resonance assay, biolayer interferometry assay, a spectrophotometric assay, and an electronic sensory assay.

In one embodiment, the method includes a step of determining the level of anti-influenza antibody present in the individual prior to administering the vaccine. However, it is also possible to determine the level of anti-influenza antibody present in the individual from prior medical records, if such information is available.

While not necessary to perform the disclosed method, it may be preferable to wait some period of time between the step of administering the vaccine and the step of determining the level of anti-influenza antibody in the individual. In one embodiment, determination of the level of anti-influenza antibodies present in the individual is performed at least 1 day, at least 2 days, at least 3 days, at least 4 days, at least 5 days, at least 6 days, at least one week, at least two weeks, at least three weeks, at least four weeks, at least two months, at least three months or at least six months, following administration of the vaccine.

The present invention also includes kits suitable for detecting anti-influenza antibodies. Suitable means of detection include the techniques disclosed herein, utilizing nanoparticles of the present invention. Kits may also comprise a detectable marker, such as an antibody that selectively binds to the nanoparticle, or other indicator molecules. The kit can also contain associated components, such as, but not limited to, buffers, labels, containers, inserts, tubings, vials, syringes and the like.

EXAMPLES

The following examples are put forth so as to provide those of ordinary skill in the art with a complete disclosure and description of how to make and use the embodiments, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, and temperature is in degrees Celsius. Standard abbreviations are used.

Example 1: Iterative Structure-Based Design of HA Stabilized-Stem (HA-SS) Constructs This example shows the six iterative cycles of structure-based design (Gen1-Gen6) used to produce the HA stabilized-stem (HA-SS) immunogens that lack the immunodominant head domain.

Influenza A viruses comprise 18 HA subtypes of which two, H1 and H3, currently cause the majority of human infections. Seasonal influenza vaccines provide some protection against circulating H1 and H3 strains, but little protection against the divergent H5, H7, and H9 subtypes that cause occasional outbreaks of human infection as zoonoses from avian and/or swine reservoirs. The inventors hypothesized that an immune response focused on the conserved hemagglutinin (HA) stem could potentially elicit broad heterosubtypic influenza protection against diverse strains. The inventors therefore used iterative structure-based design to develop HA stabilized-stem (HA-SS) glycoproteins, which lack the immunodominant HA head region (FIG. 1).

The ectodomain sequence of A/New Caledonia/20/1999 (1999 NC) HA and the crystal structure (PDB ID 1GBN) of A/South Carolina/1/1918 (1918 SC) were used as design templates, and each generation of HA-SS variant was evaluated for expression as soluble trimers, and for antigenicity based on stem-specific monoclonal antibody (mAb) reactivity similar to wild-type (wt) HA trimer.

Plasmids encoding full-length HA and neuraminidase (NA) from 1999 NC, 1986 SG, 2009 CA, H2 2005 CAN, H5 2005 IND and H5 2004 VN were synthesized using human-preferred codons. Various versions of HA-SS were generated by overlapping PCR and site-directed mutagenesis. All HA, HA-SS proteins and mAbs were expressed in freestyle 293 (293F; Life Technologies) cells or 293 GnTI$^{-/-}$ cells (for Gen4 HA-SS crystallization) and purified as previously described (Wei, C. J., et al. Elicitation of broadly neutralizing influenza antibodies in animals with previous influenza exposure. *Sci. Transl. Med.* 4, 147ra114 (2012)). Construction, purification, and characterization of HA-np and Gen1- Gen6 HA-SS and Gen4-6 HA-SS-np were performed as described (Kanekiyo, M., et al. *Nature* 499, 102-106 (2013)).

The first generation design (Gen1 HA-SS) replaced the receptor-binding domain (residues HA1 51-277, H3 numbering) with a GSG linker (FIG. 1). The HA ectodomain trimer and all trimeric HA-SS designs were each generated with the C-terminal transmembrane and cytoplasmic residues HA2 175-220 (H3 numbering) replaced with a short linker, T4 foldon, thrombin cleavage site and His tag. The HA1/HA2 cleavage site was mutated to prevent cleavage. To model the structures of the HA-SS designs, 1918 SC HA (PDB ID 1GBN) and the bacteriophage T4 foldon trimer (PDB ID 1RFO) were used as templates, loops and connections were designed using LOOPY (Xiang, et. al. *Proc. Natl. Acad. Sci. U.S.A.* 99, 7432-7437 (2002)), side chains were mutated using SCAP (Xiang, et al., *J. Mol. Biol.* 311, 421-430 (2001)) and structural superpositions were performed using LSQMAN (Kleywegt, et al., in International Tables for Crystallography, Vol. F, 353-367 (Kluwer Academic Publishers, Dordrecht, The Netherlands, 2001)). The energetics of particular mutations were assessed computationally using the Rosetta program DDG MONOMER (Kellogg, et al., *Proteins* 79, 830-838 (2011)). Chimera (Pettersen, E. F., et al. *Journal of Computational Chemistry* 25, 1605-1612 (2004)) was used to perform surface area calculations. Approximately 700 trimeric structures in the Protein Data Bank (PDB) were examined to find a suitable trimerization domain to further stabilize HA-SS immunogen. This search revealed HIV-1 gp41 (PDB ID 1SZT) to be optimal for (i) its size (less than 70 amino acids per monomer), (ii) its thermostability ($T_m=70°$ C.), (iii) ease of transplantation, with N- and C-termini located at the same end of the trimer, and (iv) structural complementarity between the C-terminal ends of the inner heptad repeat 1 (HR1) helices of gp41 and the inner C helices of the HA-SS trimer. Gen1 HA-SS failed to express as a trimer, despite the presence of a C-terminal foldon trimerization domain.

To increase trimer stability in the second generation, the inventors replaced HA2 residues 66-85 at the membrane-distal region of the HA-SS with a thermostable HIV-1 gp41 trimerization domain (see Tan, et al., *Proc. Natl. Acad. Sci. U.S.A.* 94, 12303-12308 (1997)) in which the inner heptad repeat 1 (HR1) helices are structurally complementary with the inner C helices of the HA stem. Connecting gp41 and HA-SS necessitated circular permutation of gp41 helices HR1 and HR2, which were reversed in order and reconnected with a glycine-rich linker (FIG. 1). To insert the six-helix bundle of the post-fusion form of HIV-1 gp41 into Gen2 HA-SS, residues 28-32 (residues 573-577, HXBc2 numbering) from the three inner helices of gp41 were superimposed onto HA inner helix residues HA2 81-85 (from PDB ID 1RU7) with a root mean square deviation (RMSD) of 1.41 Å for 15 Ca atoms. HA2 residues 66-85 were replaced with the gp41 heptad repeat (HR) 2 helix (residues 628-654, HXBc2 numbering) followed by a six-residue glycine rich linker (NGTGGG) containing the sequon for an N-linked glycosylation site and the gp41 HR1 helix (residues 548-577). HR1 was designed to be in frame with helix C of HA2 to generate a long central chimeric helix. Efforts to stabilize the membrane distal portion of the F' region through the addition of salt bridges, shortening loops and reducing its hydrophobicity did not improve the trimerization or antigenicity of the Gen2 HA-SS design. Expression of Gen2 HA-SS resulted in 29% trimerization.

To improve trimerization in the third generation, a 44-residue portion of the HA1 F' region with irregular secondary structure was removed, and the inner helix C of HA-SS was truncated by six residues for better complementarity between gp41 and HA2. This resulted in a soluble Gen3 HA-SS with 77% trimerization, which was recognized by HA stem broadly neutralizing mAbs (bNAbs) with affinities similar overall to those of the soluble HA trimer (FIG. 1). In Gen3 HA-SS HA2 residues 43-50, and 278-313 of the F' region were replaced with a GWG linker, and HA2 residues 60-65 and 86-92 were removed. To realign gp41 with a lower region of the HA stem, residues 30-34 (575-579 Hxbc2 numbering) from the three inner helices of gp41 were superimposed onto HA inner helix residues HA2 90-94 with an RMSD of 0.59 Å for 15 Ca atoms. Faster off-rates were observed for CR6261 and 70-5B03 which may be due in part to the loss of the HA F' region that can make limited contact with the CR6261 heavy chain.

To characterize the Gen3 HA-SS at the atomic-level, the inventors determined the crystal structure of Gen3 HA-SS in complex with the antigen-binding fragment (Fab) of the murine bNAb C179 (see Okuno, Y., et al. *J. Virol.* 67, 2552-2558 (1993)) at 3.19 Å resolution (FIG. 2*a*, left panel); the C179 antibody was the first broadly neutralizing HA stem-directed antibody to be discovered with heterosubtypic neutralization.

C179 harvested from hybridoma cells was cleaved into Fabs as previously described (Ofek, G., et al. *J. Virol.* 78, 10724-10737 (2004)) with the following modifications: LysC (Roche) was used at a ratio of 1:20,000 (w/w) to C179 and the crystallizable fragment (Fc) was removed from the digestion solution by passing through a mercapto-ethyl-pyridine column (Pall Life Sciences) in 50 mM Tris pH 8.0 and the C179 Fab was eluted with 50 mM NaAc pH 5.0.

The complex of Gen3 HA-SS (expressed in 293 $GnTI^{-/-}$ cells) with C179 Fab was obtained by passing a 1:1.25 (Gen3 HA-SS/C179 molar ratio) mixture through a Superdex 200 26/60 (GE Healthcare) gel filtration column and collecting the peak eluting at 152.0 mLs. The complex was concentrated to 10 mg/ml in 150 mM NaCl, 10 mM Tris HCl pH 7.5 and crystallized at 20° C. by hanging drop vapor diffusion in 15% (W/V) polyethylene glycol 1500, 5% (V/V) 2-methyl-2,4-pentanediol, 200 mM $NH_4Cl$ and 100 mM Tris HCl pH 8.5, derived from the precipitant synergy crystallization screen (Majeed, S., et al. *Structure* 11, 1061-1070 (2003)). Crystals were cryocooled without any additional cryoprotectant and stored in liquid nitrogen prior to data collection.

X-ray data was collected to 3.19 Å resolution at a temperature of 100K using a wavelength of 1.000 Å at the Southeast Regional Collaborative Access Team (SER-CAT) 22-BM beamline at the Advanced Photon Source (APS), Argonne National Laboratory. X-ray data was processed with HKL2000 in the trigonal space group H3 and the structure of the complex was determined by molecular replacement using five separate search models. PHASER (Mccoy, A. J., et al. *J. Appl. Crystallogr.* 40, 658-674 (2007)) was used to search with the HA stem monomer from the structure of 1934 PR8 (PDB ID 1RU7, residues 5-36, 315-323 HA1 chain A and residues 514-559, 590-660 HA2 chain B), the HIV-1 gp41 monomer (PDB ID 1SZT, residues 3-29, 42-67), the heavy chain variable domain of the murine antibody S25-2 (PDB ID 1Q9K, residues 1-111), and the light chain variable domain of the murine antibody MN16C13F4 (PDB ID 1UWX, residues 3-108). MOLREP (Collaborative Computational Project. *Acta Crystallogr. D Biol. Crystallogr.* 50, 760-763 (1994)) was used to locate the T4 foldon monomer (PDB ID 1RFO, chain A) which confirmed an independent fitting by hand. The C179 Fab constant domains were fit into Fo-Fc density by eye prior to refinement using the constant domains of the above Abs (PDB IDs 1Q9K and 1UWX) as templates. Model building and refinement were performed using COOT (Emsley, P. & Cowtan, K. Coot: *D Biol. Crystallogr.* 60, 2126-2132 (2004)) and PHENIX (Adams, P. D., et al. *Acta Crystallogr. D Biol. Crystallogr.* 58, 1948-1954 (2002)) with riding hydrogens, respectively. All of the residues of the Gen3 HA-SS were modeled into electron density except for the HA cleavage loop (residues 48-52), the glycine rich loop connecting the gp41 helices (residues 139-144), the linker connecting HA-SS to the foldon (residues 256-259) and the thrombin cleavage site and His tag C-terminal to the foldon domain (residues 286-302). Carbohydrates were observed and built on Asn residues 23, 119 and 236. The C179 structure included heavy chain residues 1-213 and light chain residues 1-214. The Ramachandran statistics as determined by PHENIX revealed 91.64% of residues in favored regions, 7.49% in allowed and 0.86% as outliers.

The co-crystal structure revealed C179 recognition of Gen3 HA-SS to be similar to the recognition of an H2N2 trimeric HA in the recently published co-crystal structure of C179 with an A/Japan/305/1957 (1957 JP) HA (see Dreyfus, et al., *J. Virol.* 87, 7149-7154 (2013).) (FIG. 2*a*, right panel). While these findings confirmed the preservation of the stem epitope on the Gen3 HA-SS; the overall structure revealed several unexpected differences (FIG. 2*a*, left and middle panel). First, the stem trimer subunits were splayed apart at their C-termini by approximately 15 Å relative to HA (FIG. 2*a*, middle panel). Second, the C-terminal foldon trimerization domain was inverted and tucked inside the stem trimer into the splayed region (FIG. 2*a*, left panel). Finally, the outer helix A of the HA stem forms a continuous helix with the outer HR2 helix of the gp41 six-helix bundle, rather than forming two separate helices separated by a glycine linker.

To address these issues, a fourth generation HA-SS was created containing three mutations (outlined in FIG. 1) in an effort to remove potential side chain clashes and disrupt the continuous helix between helix B of HA2 and the gp41 HR2 (FIG. 2*b*).

To crystalize the Gen4 HA-SS/CR6261 complex, the Gen4 HA-SS (expressed in 293 $GnTI^{-/-}$ cells) was deglycosylated by incubating with endoglycosidase H (77 U/μg Gen4 HA-SS) for 4 hrs. at 37° C. followed by passage through a concanavalin A column (Sigma) to remove protein with uncleaved N-linked glycans. The complex with CR6261 Fab was obtained by passing a 1:1.25 (Gen4 HA-SS/CR6261 molar ratio) mixture through a Superdex 200 10/300 (GE Healthcare) gel filtration column and collecting the peak eluting at 12.5 mLs. The complex was concentrated to 11 mg/ml in 150 mM NaCl, 10 mM Tris HCl pH 7.5 and crystallized at 20° C. by hanging drop vapor diffusion in 7% (w/v) polyethylene glycol 4000, 4.5% (v/v) isopropanol, 100 mM imidazole pH 6.5. The crystal was soaked in a reservoir solution containing an additional 5% (v/v) 2R,3R butanediol (Sigma) for six hours at room temperature followed by a brief 30 second transfer to a reservoir solution containing 15% 2R,3R butanediol before flash cooling.

X-ray data was collected to 4.30 Å resolution at a temperature of 100K using a wavelength of 1.000 Å at the SER-CAT BM-22 beamline of APS. Data was processed with HKL2000 (ref 37) in the space group H3 and the structure of the complex was determined by molecular replacement using three separate search models. PHASER was used to search with the HA stem monomer from the structure of 1934 PR8, the HIV-1 gp41 monomer (same models as above), and the variable and constant domains of CR6261 (PDB ID 3GBM). Model building and refinement were performed using COOT and PHENIX, respectively. All of the residues of the Gen4 HA-SS were modeled into electron density except for the HA cleavage loop (residues 48-52), the glycine rich loop connecting the gp41 helices (residues 137-145), and the C-terminal foldon (residues 256-259), the thrombin cleavage site and His tag C-terminal to the foldon domain (residues 286-302). While density was visible inside of the HA stem in the same region observed in the Gen3 HA-SS structure, it was not sufficient to uniquely place or stably refine a foldon domain. The CR6261 Fab structure included heavy chain residues 1-213 and light chain residues 3-107 and 113-215. The Ramachandran statistics as determined by PHENIX revealed 93.19% of residues in favored regions, 6.09% in allowed and 1.06% as outliers.

For cryo-electron microscopy analysis, particles were vitrified over holey carbon films (Quantfoil, GroBlobichau, Germany) using a Vitrobot Mark IV (FEI Company, Hillsboro, Oreg.). Cryo-images of particles were collected on a Titan Krios electron microscope (FEI Company, Hillsboro, Oreg.), operated at liquid nitrogen temperatures and operated at 300 kV. Images were collected on a 4,096×4,096 charge-coupled-device (CCD) camera (Gatan Inc., Warrendale, Pa.) at a pixel size of 1.2 Å with defocus values ranging from approx. 2.8 to approx. 6 µm, and at doses ranging from approx. 10 to 20 e-/Å$^2$. Observed defocus values were fit using ctffind3 (Mindell, J. A. & Grigorieff, N. *J Struct Biol* 142, 334-347 (2003)), and images that exhibited drift or astigmatism were excluded from further analysis. Particles (13,464) were manually picked from images. Reference-free 2D classification indicated octahedral symmetry, which was imposed during 3D refinement. A smooth, spike less, low-pass filtered ferritin (PDB ID 2JD6) was used as a staring model. After removal of overlapping particles during the refinement process, the reconstruction (3D map) was calculated from 6,540 particles. All image analyses (2D and 3D) were carried out with the Relion package (Scheres, S. H. W. *J. Mol. Biol.* 415, 406-418 (2012).). Visualization and molecular docking of model coordinates were performed with Chimera.

Atomic coordinates and structure factors for Gen3 HA-SS in complex with C179 and Gen4 HA-SS complex with CR6261 have been deposited under PDB codes 4MKD and 4MKE respectively. The cryo-electron microscopy map for H1-SS-np has been deposited under the EMDB code EMD-6332.

The co-crystal structure at 4.30 Å resolution of Gen4 HA-SS complexed with a Fab of the bNAb CR6261 (see Ekiert, D. C., et al. *Science* 324, 246-251 (2009)) revealed that the splaying relative to gp41 persists, with an additional rotation of –19° (FIG. 2b, middle panel). However, the level of trimerization (83%), preservation of stem-epitope conformation, and HA stem bNAb binding (nM to four bNAbs) were near optimal in the Gen4 HA-SS (FIGS. 1a and 2b).

The inventors were concerned about the implications of an immunogenic HIV-1 gp41 region, and therefore sought to replace gp41 with a short glycine-rich linker (FIG. 1a), as this would also increase the percentage of the HA stem on the immunogen surface (FIG. 1b). The gp41 replacement was carried out in two contexts, a Gen5 HA-SS, which retained the Gen4 stabilized-stem region, and a Gen 6 HA-SS, in which an internal salt bridge comprising Lys51-Glu103 (HA2, H3 numbering) was replaced by a nearly isosteric Met-Leu hydrophobic pair (Gen6 HA-SS, FIG. 1c).

The Gen5 HA-SS was created by completely removing the gp41 trimerization domain, connecting HA2 residues 58-93 with a GSGGSG loop and introducing the HA2 mutations Y94D and N95L.

Figure 1C:
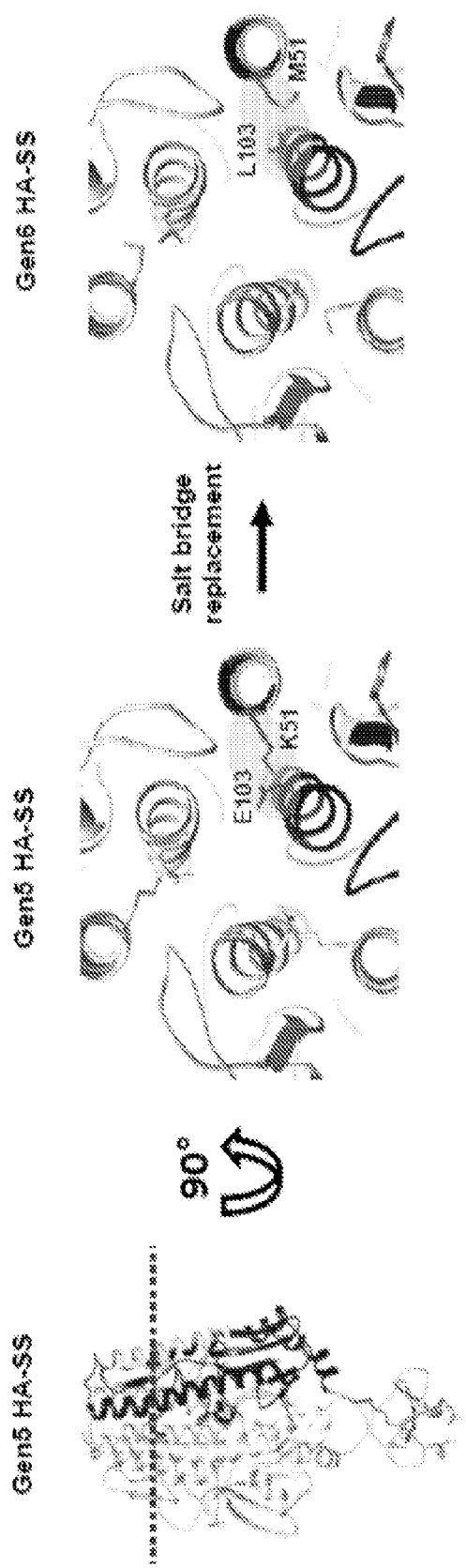
FIG. 1c show a ribbon representation depicting a cross-sectional view of the replacement of the Glu103-Lys51 salt bridge with the Leu103-Met51 hydrophobic pair in Gen6 HA-SS. The dotted line (left) indicates the location of the cross-section.
Figure 1D:
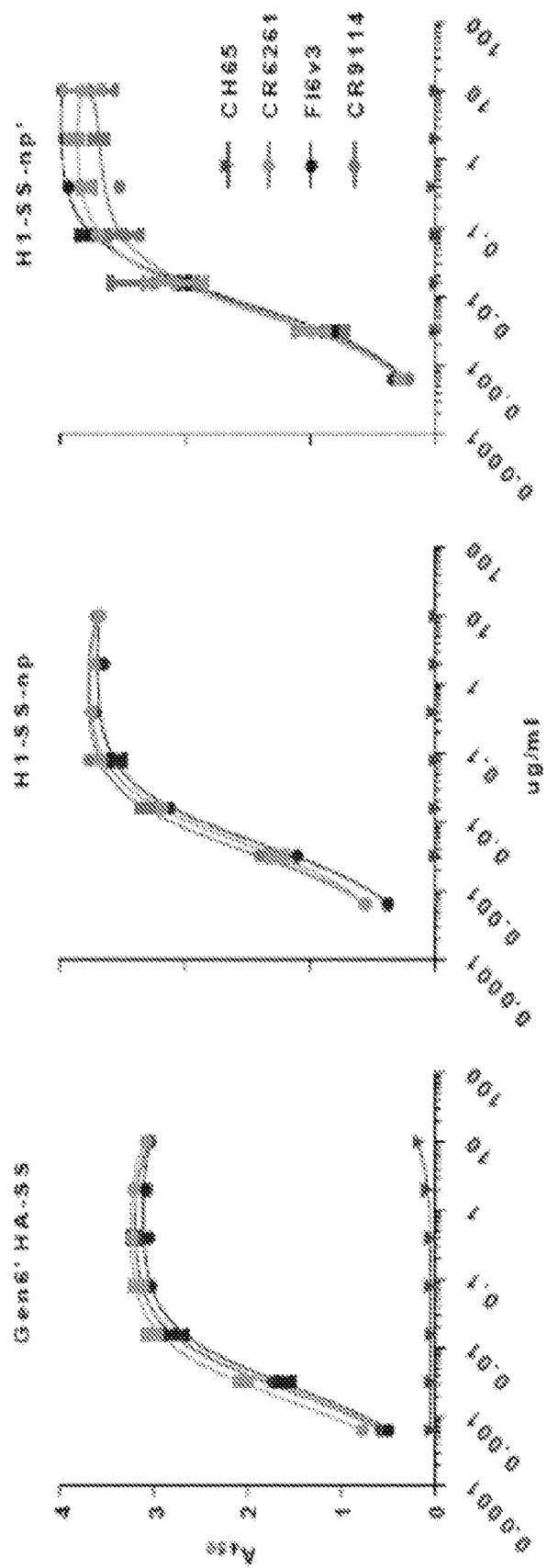
FIG. 1d shows the antigenicity of Gen6 HA-SS presented in its soluble and nanoparticle formats. The three panels show ELISA binding of one head (CH65) and three stem-specific antibodies (CR6261, CR9114, FI6v3) to Gen6' HA-SS (left panel), H1-SS-np (middle panel), and H1-SS-np' (right panel). ELISA binding of antibodies ranging in concentration from 10-6.40×10$^{-4}$ μg/mL.
Figure 2A:
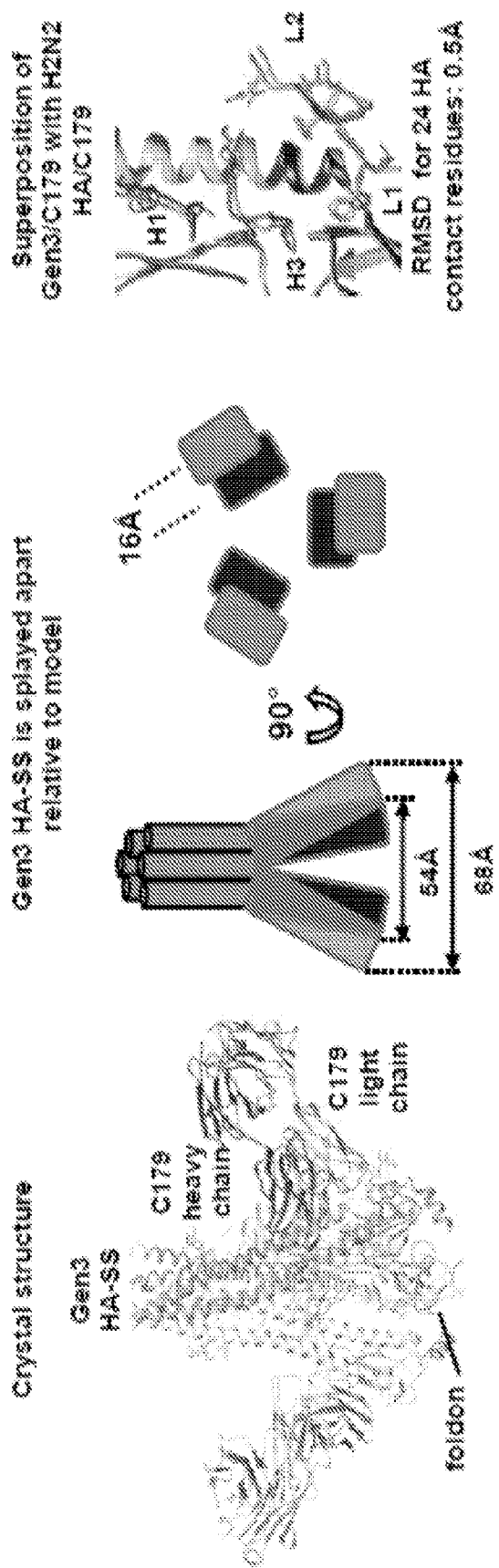
FIG. 2a shows that the trimeric, but not nanoparticle stem immunogens, display HA stem splaying. The left panel depicts a ribbon diagram of the crystal structure of the complex between Gen3 HA-SS (dark and gray) and mAb C179 (labeled). The middle panel of FIG. 2a shows a cartoon comparing the splaying of the crystal structure (light) with the model (dark) in two different views (side and bottom). The right panel of FIG. 2a shows a superposition of the Gen3 HA-SS/C179 binding interface with a 1957 H2N2 HA/C179 binding interface (PDB ID 4HLZ). Antibody CDR loops are labeled by "H" for heavy chain and "L" for light chain. The heavy chain framework 3 loop is labeled FR3. RMSD, root mean square deviation.
Figure 2B:
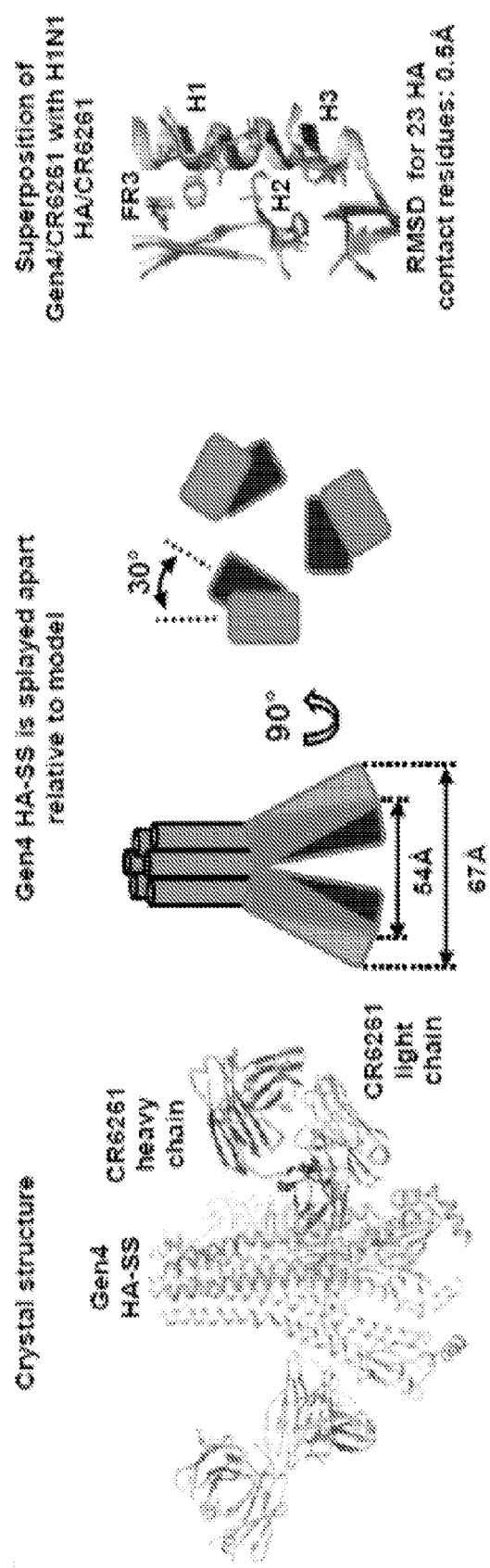
FIG. 2b depicts the same panel format as in FIG. 2a, showing Gen4 HA-SS and in the right panel a superposition of the Gen4 HA-SS/CR6261 heavy chain binding interface with the 1918 H1N1 HA/CR6261 binding interface (PDB ID 3GBN).
Figure 2C:
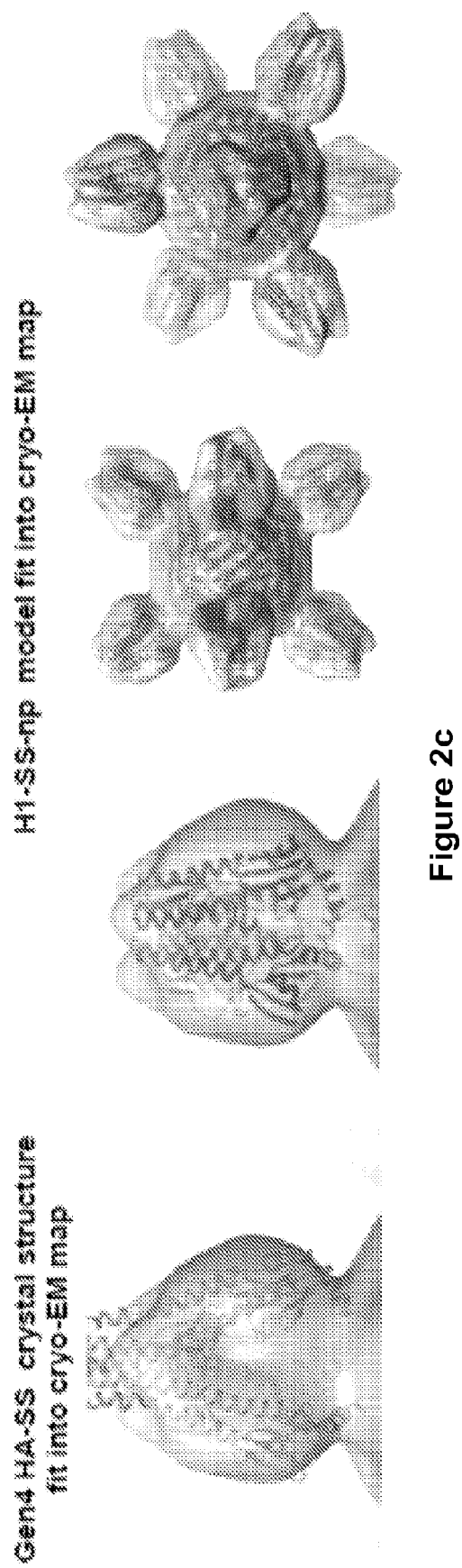
FIG. 2c shows the H1-SS-np cryo-electron microscopy analysis. The first two panels show the Gen4 HA-SS crystal structure (cropped) and the H1-SS-np model, respectively, fit into the cryo-electron microscopy map for one H1-SS-np spike. The next two panels of FIG. 2c show two different views of the entire H1-SS-np model fit into the H1-SS-np cryo-electron microscopy map.
Figure 2D:
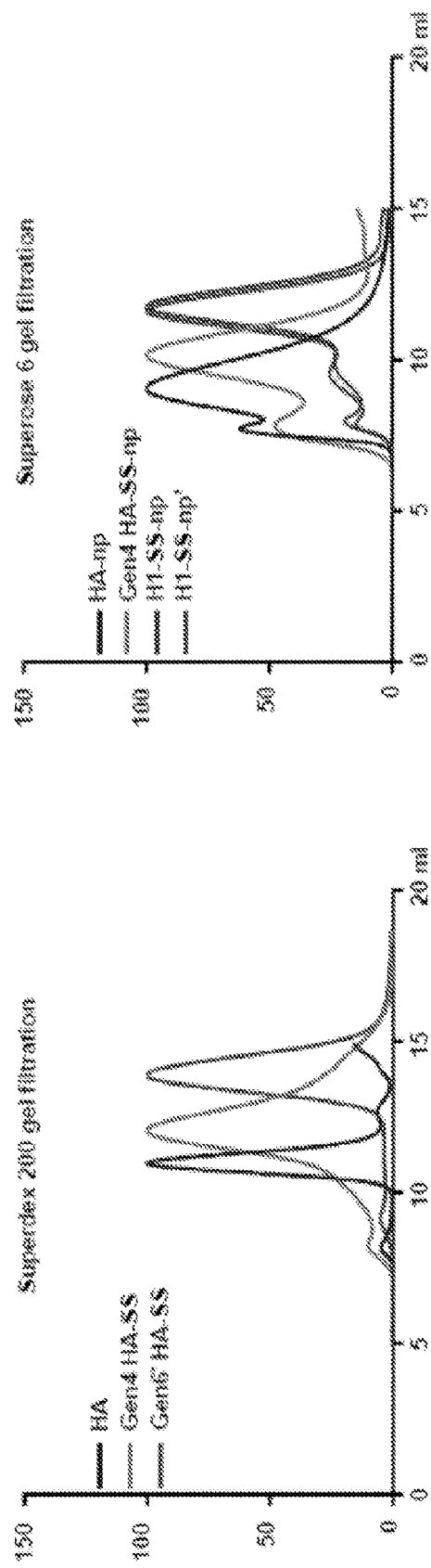
FIG. 2d shows the characterization of influenza virus HA and HA-SS insoluble and nanoparticle formats in the size exclusion chromatogram of HA, Gen4 HA-SS and H1-SS-np' (left panel), and HA np, Gen4 HA-SS-np and H1-SS-np' and H1-SS-np (right panel) with a Superdex 20010/300 and Superose 610/300 column, respectively.
Figure 2E:
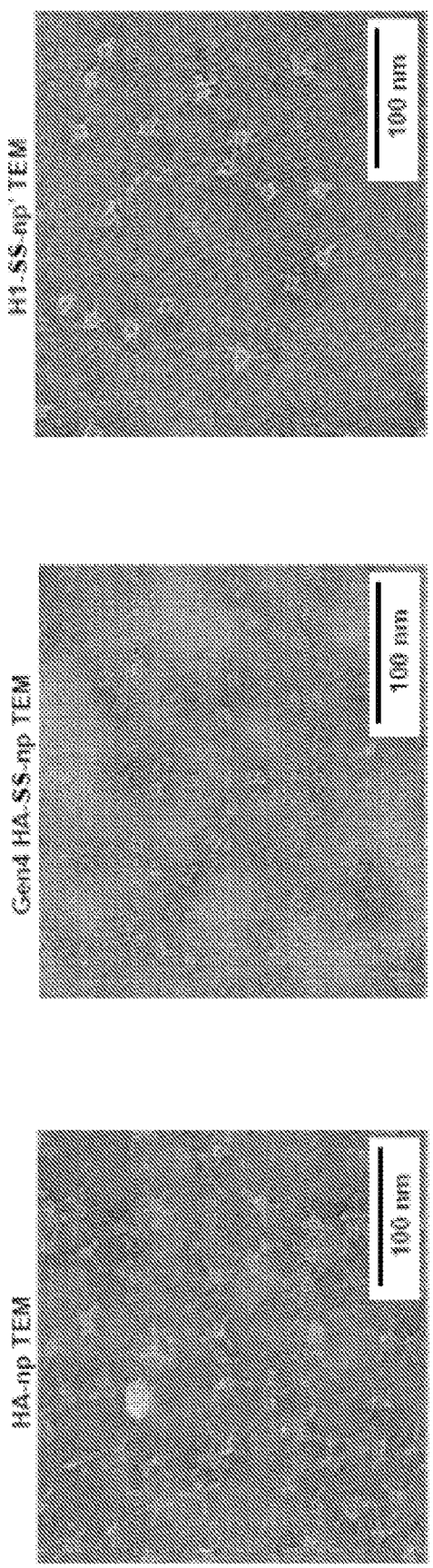
FIG. 2e negatively stained transmission electron microscopy images of HA-np (left panel) and Gen4 HA-SS-np (middle panel) and H1-SS-np (right panel). Images were originally recorded at 67,000× magnification.
Figure 2F:
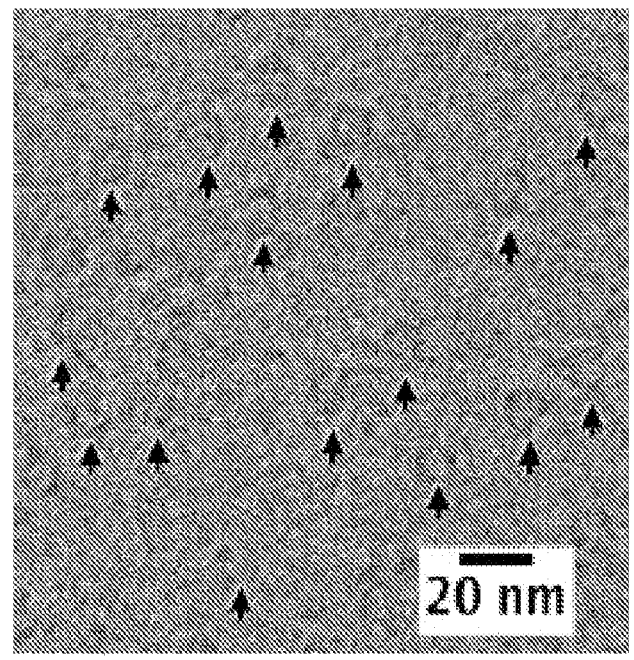
FIG. 2f shows a cryo-EM image of a field of H1-SS-np. Arrows depict some ring-like nanoparticles; scalebar is 20 nm.
Figure 2G:
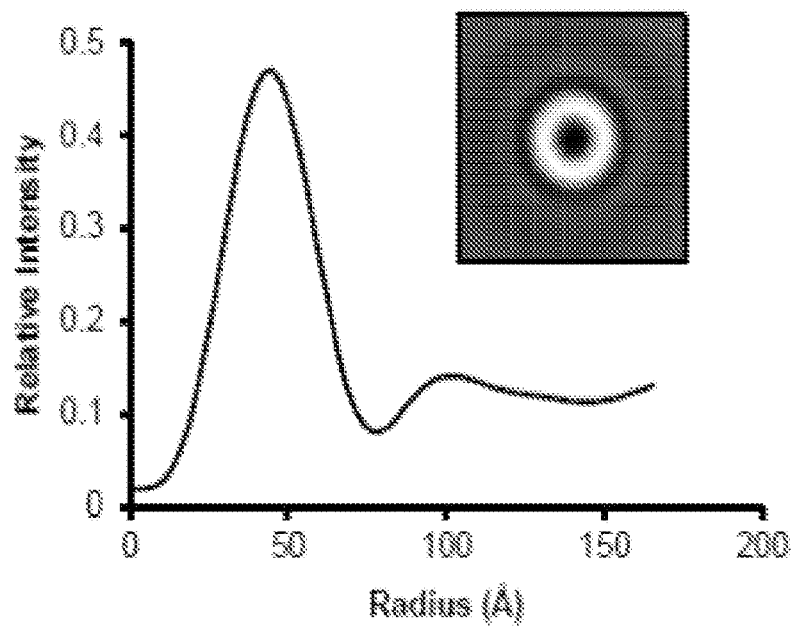
FIG. 2g shows a size analysis of H1-SS-np by 2D radial density profile (curve) of the global circular average of nanoparticles (inset). The profile illustrates a two-layered structure with a base peak centered at about 40 Å from the particle center and a second peak spanning the range of about 80 Å to 140 Å. The difference in peak heights is consistent for a more continuous protein layer topped by a layer containing a few discrete spikes.
Figure 2H:
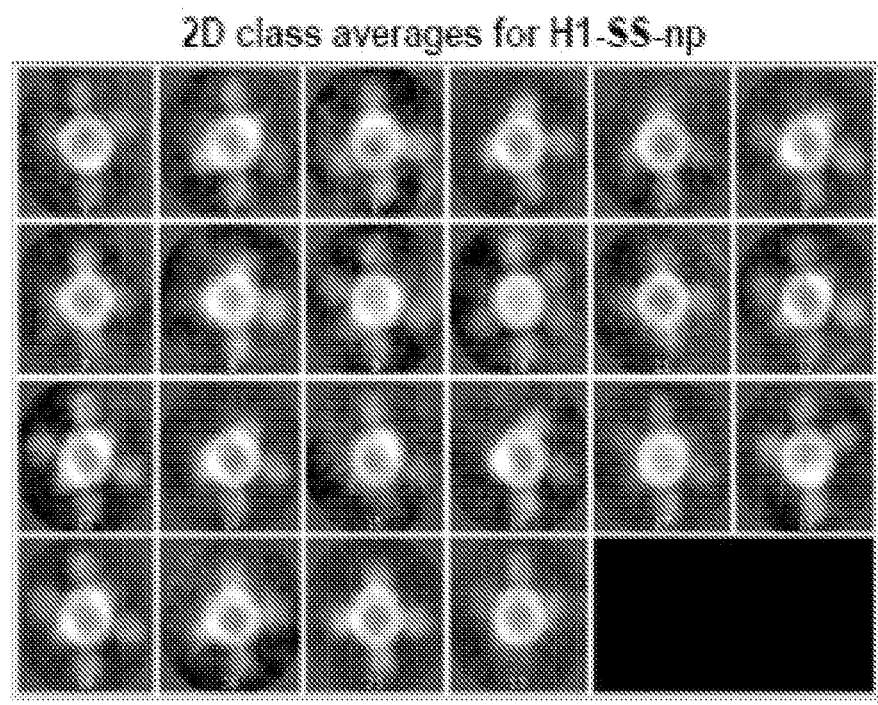
FIG. 2h shows the reference-free 2D class averages of H1-SS-np with no symmetry imposed. Classes indicate distinct views of a particle with a protein shell and protruding spike densities and views are consistent with expected octahedral symmetry.
Figure 2I:
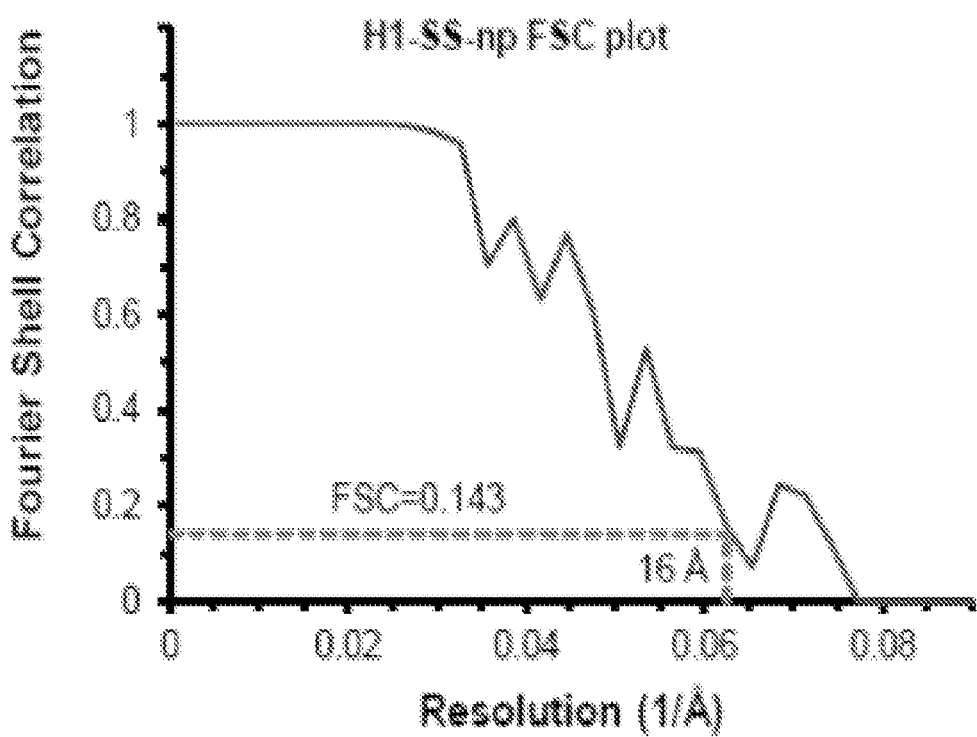
FIG. 2i resolution assessment of the H1-SS-np 3D reconstruction by Fourier shell correlation (FSC) plot. FSC (0.143) was used as the cut-off following the gold-standard procedure as implemented in the RELION software package.

To design Gen6 HA-SS, five mutations were initially created to stabilize the inner core of the HA stem HA2: K51M, E103L, E105Q, R106W, and D109L (referred to as Gen6' HA-SS). Trimerization and recognition by HA stem antibodies were preserved for all three immunogens (FIG. 1a). The intermediate version of Gen6 HA-SS (referred to as Gen6' HA-SS) containing three additional internal stabilizing mutations displayed similar antigenicity (FIG. 1d), but mutations E105Q, R106W, and D109L were ultimately observed not to be required for stabilization of Gen6 HA-SS and fusion with ferritin and were not used in the final H1-SS-np construct (FIG. 1c).

Example 2: Creation of Self-Assembling Ferritin Nanoparticles

This example describes the fusion of Gen4, Gen5, Gen6', and Gen6 HA-SS to the self-assembling ferritin nanoparticle through their respective HA C-termini.

Immunogenicity of HA is substantially increased in the context of a self-assembling nanoparticle (HA-np) (see Kanekiyo, M., et al., *Nature* 499, 102-106 (2013)). Moreover, the inventors speculated that a C-terminal fusion to the nanoparticle might reduce the splaying of the membrane-proximal regions of the stem. The inventors therefore genetically fused Gen4, Gen5, Gen6', and Gen6 HA-SS through their respective HA C-termini (replacing the foldon) to the self-assembling ferritin nanoparticle of *H. pylori* to create HA-SS-nanoparticles (HA-SS-np).

Gen4-6 HA-SS were fused to *H. pylori* ferritin N-terminus (residues 5-167) with a SGG linker to produce HA-SS ferritin nanoparticles (Gen4 HA-SS-np, H1-SS-np and H1-SS-np') as described (Kanekiyo, M., et al. *Nature* 499, 102-106 (2013)).

A fortéBio Octet Red384 instrument was used to measure binding kinetics of HA and HA-SS molecules to mAbs CR6261, CR9114, F10 scFv and 70-5B03. All the assays were performed at 30° C. with agitation set to 1,000 rpm in PBS supplemented with 1% BSA in order to minimize nonspecific interactions. The final volume for all the solutions was 100 µl/well. Assays were performed at 30° C. in solid black 96-well plates (Geiger Bio-One). HA or HA-SS with a C-terminal biotinylated Avi-Tag (25 µg/ml) and HA-np or HA-SS-np in 10 mM acetate pH 5.0 buffer were used to load streptavidin and amine-reactive biosensor probes respectively for 300 s. Typical capture levels were between 0.8 and 1 nm, and variability within a row of eight tips did not exceed 0.1 nm. Biosensor tips were equilibrated for 300 s in PBS/1% BSA buffer prior to binding measurements of the Fabs or F10 scFv in solution (0.01 to 0.5 µM). Upon antibody addition, association was allowed to proceed for 300 s; binding was then allowed to dissociate for 300 s. Dissociation wells were used only once to prevent contamination. Parallel correction to subtract systematic baseline drift was carried out by subtracting the measurements recorded for a sensor loaded with HA or HA-SS molecules incubated in PBS/1% BSA. To remove nonspecific binding responses, a biotinylated gp120 resurfaced core molecule was loaded onto the streptavidin probe and incubated with anti-stem antibodies, and the nonspecific responses were subtracted from HA and HA-SS response data. Data analysis and curve fitting were carried out using Octet software, version 7.0. Experimental data were fitted with the binding equations describing a 1:1 interaction. Global analyses of the complete data sets assuming binding was reversible (full dissociation) were carried out using nonlinear least-squares fitting allowing a single set of binding parameters to be obtained simultaneously for all concentrations used in each experiment.

ELISA, hemagglutination inhibition (HA1) assay and pseudotype neutralization assays were performed as previously described (Wei, C. J., et al. *Science* 329:1060-1064 (2010)). The recombinant HA/NA lentiviral vectors expressing a luciferase reporter gene were produced as described (Wei, C. J., et al. *Sci. Transl. Med.* 2, 24ra21 (2010)). All influenza viruses were obtained from Centers for Disease Control and Prevention (CDC; Atlanta, Ga.).

Figure 1E:
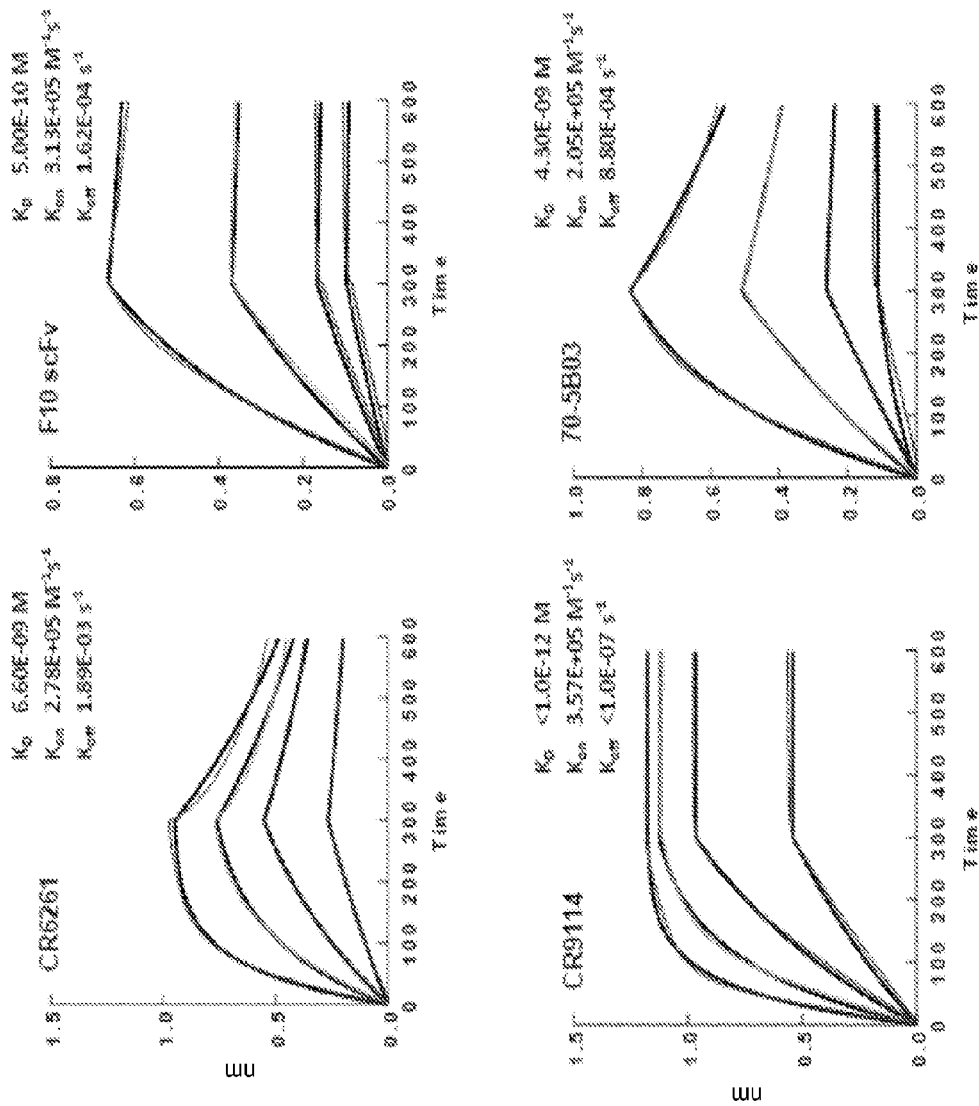
FIG. 1e and FIG. 1f show the Octet sensorgrams of H1-SS-np (FIG. 1e) and H1-SS-np' (FIG. 1f) binding to HA stem-directed bNAbs. H1-SS-np was immobilized onto an Octet probe and incubated with varying concentrations of antibody binding fragments Fab or scFv stem-directed antibodies, which are indicated on top of each sensorgram.
Figure 1F:
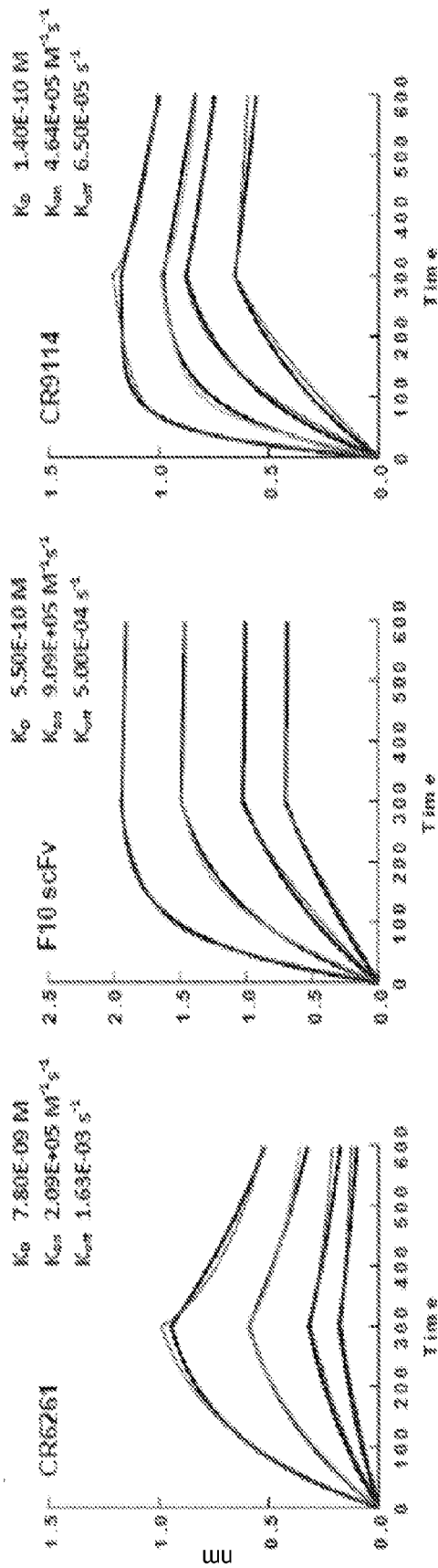

Gen4, Gen6 and Gen6' HA-SS-np each expressed as nanoparticles as confirmed by transmission electron microscopic analysis and gel filtration (FIG. 2). However, Gen5 HA-SS-np failed to express. Gen6 and Gen6' HA-SS-np were selected for further evaluation and hereafter are referred to in these Examples as H1-SS-np and H1-SS-np' respectively. Cryo-electron microscopy (EM) analysis of H1-SS-np performed to a resolution of 16 Å revealed symmetrical, spherical particles, each with eight spikes protruding from the surface (FIG. 2c). Notably, the membrane-proximal region of the Gen6 HA-SS stem fits better into electron density than Gen4 HA-SS, suggesting that the splaying is either mitigated or no longer present (FIG. 2c, left panel). Moreover, both H1-SS-np and H1-SS-np' had the desired antigenic properties, being recognized by CR6261, CR9114, F10, and 70-5B03 (see, Ekiert, D. C., et al. *Science* 324, 246-251 (2009); Sui, J., et al. *Nat. Struct. Mol. Biol.* 16, 265-273 (2009); Dreyfus, C., et al. *Science* 337, 1343-1348 (2012); Wrammert, J., et al. *J. Exp. Med.* 208, 181-193 (2011)) in ELISA and biolayer interferometry measurements, indicating the authentic HA-SS structure was preserved upon fusion to ferritin (FIGS. 1a, 1e and 1f).

Example 3: Assessing Vaccine Efficacy

This example demonstrates the characterization of various measures of vaccine efficacy for the ferritin nanoparticles fused to the HA constructs.

The inventors assessed the capacity of H1-SS-np to trigger signaling by membrane-anchored germline-reverted CR6261 B cell receptor (BCR) compared to full length HA-np using a calcium flux assay (Novak, et. al. *Cytometry* 17, 135-141 (1994)).

For the BCR activation assay, germline CR6261 BCRs (wild type and double I53A/F54A mutant) were stably expressed by lentiviral transfection (FEEKW vector; Luo, X. M., et al. *Blood* 113, 1422-1431 (2009)) of light chain and membrane-anchored IgM heavy chain into a surface IgM negative clone of Ramos B cell line. Germline CR6261 BCR positive cells were then sorted by flow cytometry (BD FACSAria; BD Biosciences) and amplified. Cells expressing >95% positivity for germline CR6261 BCR (wild type or I53A/F54A mutant) were assessed for surface expression and correct HA antigenicity. For signaling, 2500 nM of either H1-SS-np, HA np (with HA containing Y98F mutation to abolish nonspecific binding to sialic acid) or empty np was presented to 1×10⁶ Ramos B cells expressing germline CR6261 BCRs. The kinetics of calcium flux in response to BCR stimulation was measured by flow cytometry as the ratio of the $Ca^{2+}$ bound/unbound states of the dye Fura Red. This ratio for $Ca^{2+}$ flux is presented 10 seconds after exposure to ligand. A 30 second baseline was acquired prior to stimulation. Ratiometric measures for individual cells were averaged and smoothened by Kinetic analysis, FlowJo software. Functionality between germline CR6261 BCR versus germline CR6261 BCR with I53A/F54A mutation was compared by $Ca^{2+}$ flux following exposure to 0.5 μg/μl anti-human IgM F(ab')₂ (Southern Biotech).

Figure 1G:
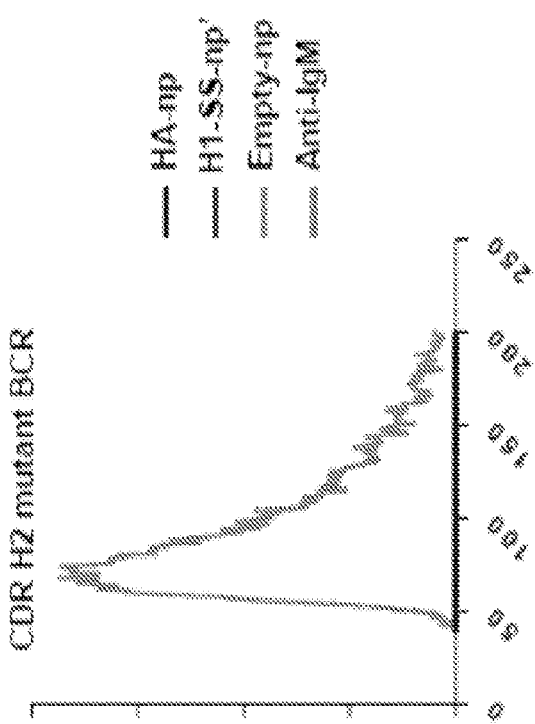
FIG. 1g shows the stimulation of wild-type IGHV1-69 v-gene reverted CR6261 BCR (left panel) vs. double Ile53Ala/Phe54Ala CDRH2 mutant BCR (right panel) by anti-IgM (=total receptor activity), empty np, HA-np (with HA containing a Y98F mutation to abolish nonspecific binding to sialic acid), and H1-SS-np' was measured by flow cytometry as the ratio of the Ca2+ bound/unbound states of the Ca2+ sensitive dye FuraRed.
Figure 1G:
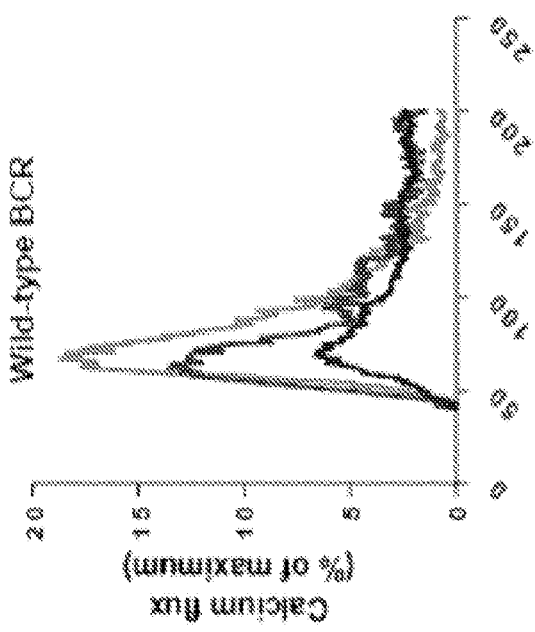

In contrast to empty ferritin particles, H1-SS-np induced effective signaling through wild-type BCR as did full-length HA-np to a lesser extent, and no signaling was observed through a BCR mutated in two critical contact residues in the second heavy chain complementarity determining region (CDR H2) (FIG. 1g). This finding confirms the ability of H1-SS-np to engage the IGHV1-69 germline precursor of CR6261 and stimulate naïve B cells through CDR H2-dependent recognition, characteristic of broadly neutralizing stem-directed antibodies found in humans.

To evaluate H1-SS-np vaccine efficacy the inventors immunized mice and ferrets using the Sigma Adjuvant System (SAS) as SAS has been reported to induce HA responses similar to MF59, another squalene-based adjuvant approved for use in humans.

For the immunization studies, a total of three animal experiments, two in mice and one in ferrets, were performed for this study. In the first mouse experiment, female BALB/c mice (6-8 weeks old, Jackson Laboratories) were immunized intramuscularly with 2 μg H1-SS-np, 2 μg of empty ferritin np, 0.2 μg of H5 2005 IND HA-np or TIV (HA molar equivalent) at week 0 and 4. Blood was collected 14 days after each immunization and serum was isolated. For the second mouse immunization experiment, female BALB/c mice were immunized three times with 3 μg of H1-SS-np or empty ferritin np at weeks 0, 8, and 12. For ferret immunization, 6 month old male Fitch ferrets (Triple F Farms, Sayre, Pa.), seronegative for exposure to currently circulating pandemic H1N1, seasonal H1N1, H3N2, and B influenza strains, were housed and cared for at BIOQUAL, Inc. (Rockville, Md.). These facilities are accredited by the American Association for the Accreditation of Laboratory Animal Care International and meet NIH standards as set forth in the *Guide for the Care and Use of Laboratory Animals*. Ferrets were immunized intramuscularly with 20 μg of H1-SS-np', or empty ferritin np or TIV (equivalent to 2.5 μg of H1 HA) in 500 μl of PBS at weeks 0 and 4. Ferrets in the positive control group were immunized with 250 μg plasmid DNA expressing H5 2005 IND followed by 2.5 μg HA of H5N1 2005 IND MIV at weeks 0 and 4. The vaccine was administered via intramuscular injections into the upper thigh muscle. Sigma Adjuvant System (SAS, Sigma) was used for all protein or np-based immunization. Blood was collected 14 days after each immunization and serum was isolated. Animal experiments were conducted in full compliance with all relevant federal regulations and NIH guidelines.

For the passive transfer studies, 150 mice were first vaccinated with H1-SS-np protein (2 μg/dose with SAS) at weeks 0 and 4, to generate HA-SS immune Ig, and sera were collected at weeks 1, 2, and 3 (terminal) post boost. Ig from immune sera was purified with protein G (Life Technologies) using the manufacturer protocol. 24 hour before challenge, two groups of BALB/c mice (n=10/group, Taconic inc.) received either naïve (Molecular innovations) or immune Ig via an intraperitoneal route. Sera were collected from infused animals 24 hours post passive transfer for serological analysis.

For virus challenge studies, the H5N1 strain, A/Vietnam/1203/04, was obtained from the Centers for Disease Control and Prevention (Atlanta, Ga.) (CDC#2004706280, E1/E3 (1/19/07) and amplified in 10-day old embryonated hen's eggs (Charles River, North Franklin, Conn.) at BIOQUAL Inc. The challenge stock has an infectious titer of $10^{10}$ TCID$_{50}$/ml. For blood collection, bleeds, and challenge procedure, the animals were anesthetized with a solution of ketamine/dexmedetomidine formulated to provide doses of 25 mg/kg ketamine and 0.001 mg/kg dexmedetomidine to each animal. Mice were inoculated intranasally with 50 µl of virus, approximately 25 µl to each nostril and ferrets were inoculated intranasally with 500 µl of virus, approximately 250 µl to each nostril. The challenge dose was 25 LD$_{50}$ in mice and 1000 TCID$_{50}$ in ferrets. Based on previous studies these challenge doses were expected to result in 100% lethality in naïve control mice and ferrets respectively. Clinical signs of infection, weight, and temperatures were recorded twice daily for ferrets. Activity scores were assigned as follows: 0, alert and playful; 1, alert but playful only when stimulated; 2, alert, but not playful when stimulated; and 3, neither alert nor playful when stimulated. Ferrets that showed signs of severe disease (prolonged fever; diarrhea; nasal discharge interfering with eating, drinking, or breathing; severe lethargy; or neurological signs) or had >20% weight loss were euthanized immediately.

Figure 3A:
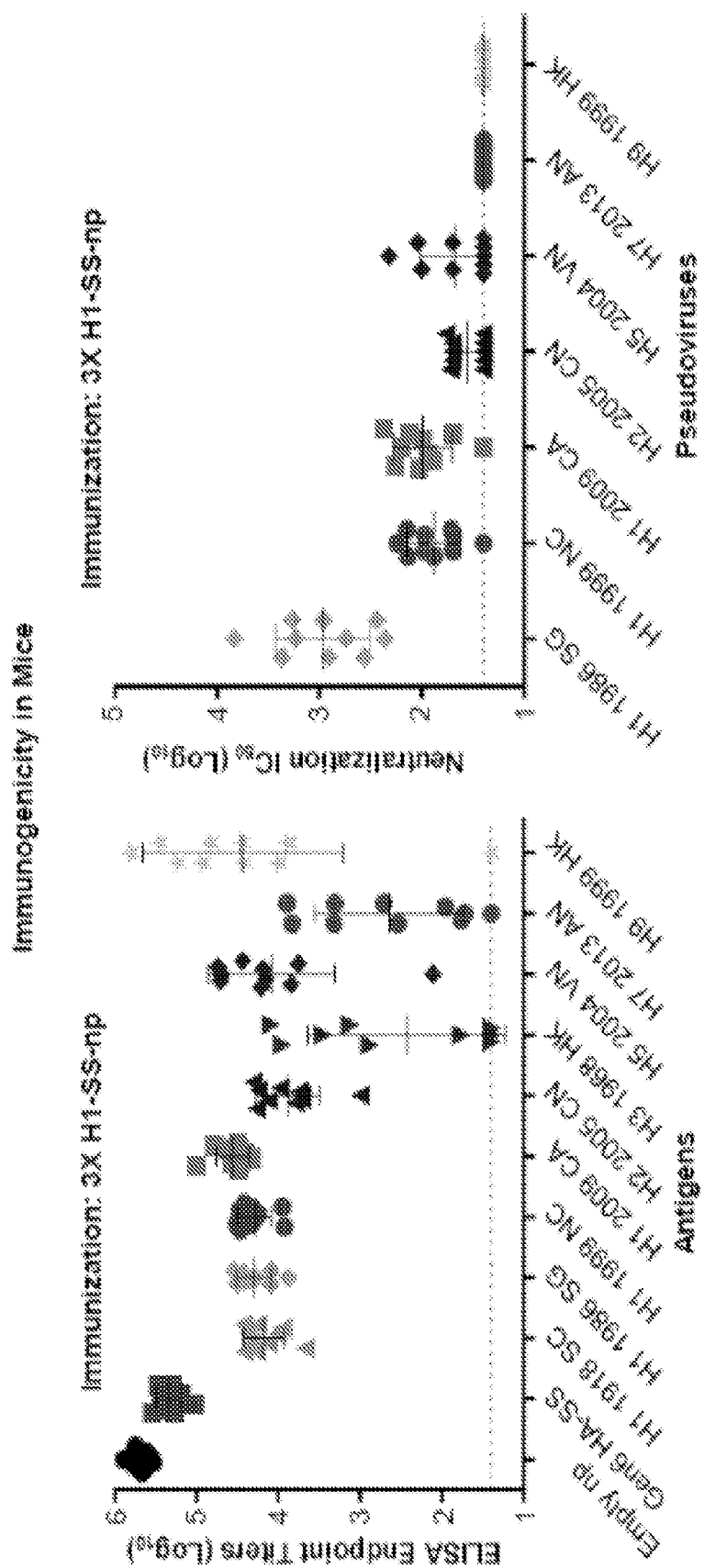
FIG. 3a shows the immune responses of immunized mice and ferrets. The left panel shows the antibody endpoint titers to diverse HA proteins and the right panel shows the neutralization titers of sera from mice (n=10 per group) immunized with SAS-adjuvanted H1-SS-np It must be noted that as used herein and in the appended claims, the singular forms "a," "an," and "the" include plural referents unless the context clearly dictates otherwise. For example, a nucleic acid molecule refers to one or more nucleic acid molecules. As such, the terms "a", "an", "one or more" and "at least one" can be used interchangeably. Similarly the terms "comprising", "including" and "having" can be used interchangeably. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.
Figure 3B:
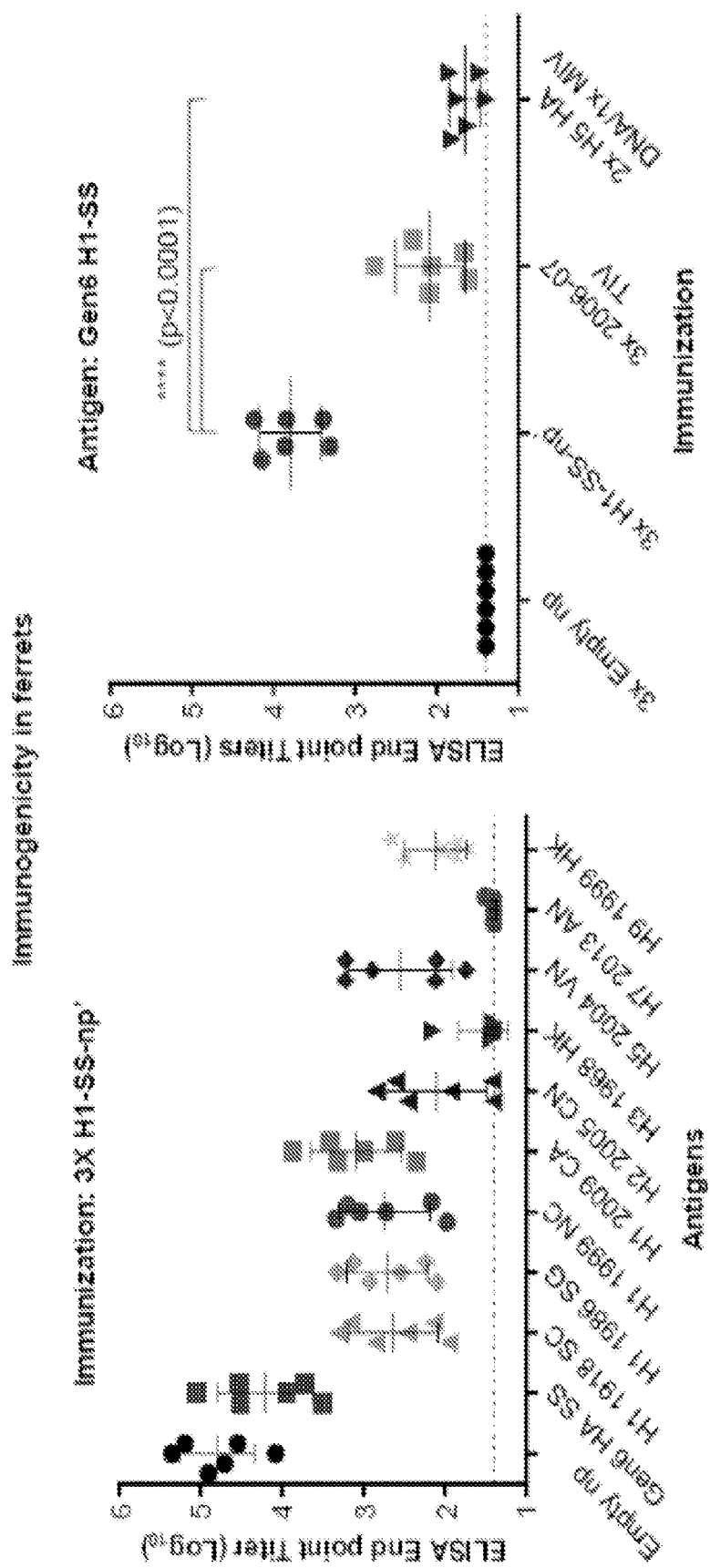
Figure 3C:
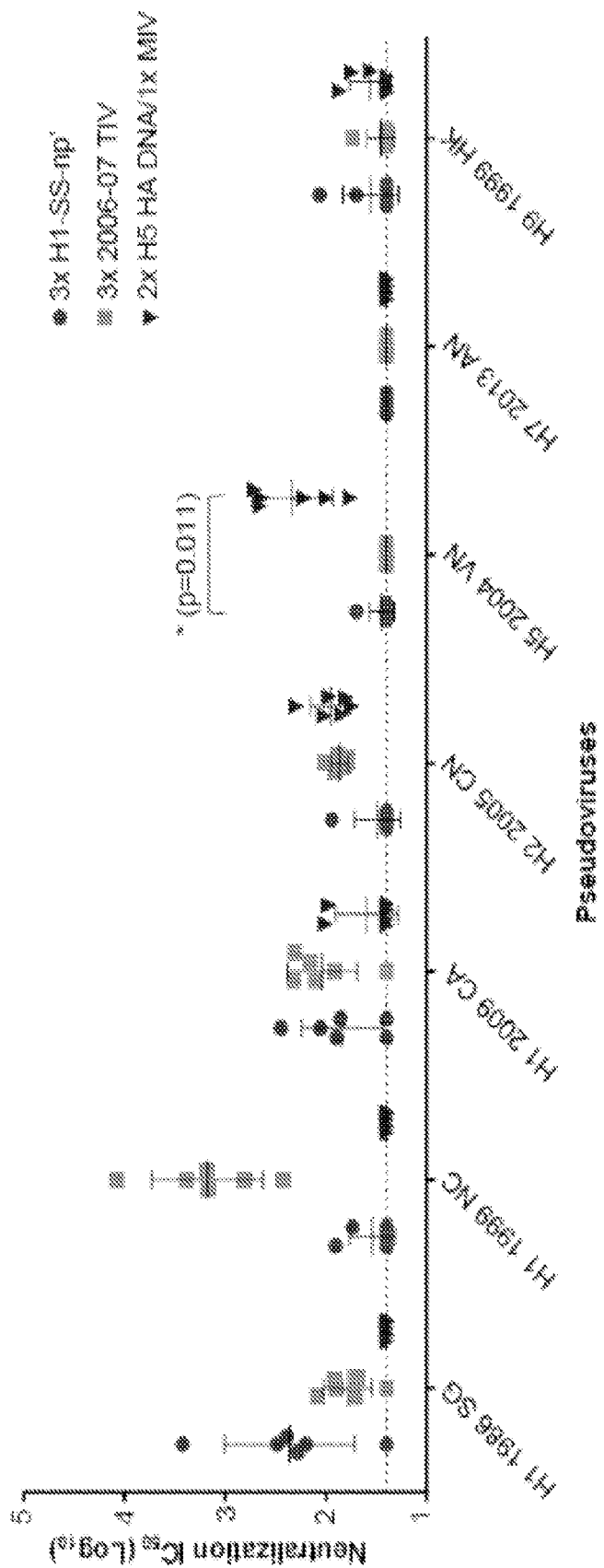

H1-SS-np and H1-SS-np' elicited broad antibody responses against group 1 HA subtypes (seasonal and pandemic H1, H2, H5 and H9) in both mice and ferrets respectively (FIGS. 3a, 3b and 3C). Furthermore, H1-SS-np induced substantial group 2 (H3 and H7) responses equivalent to those of H2 and H5 in half of the mice (FIG. 3a, left panel). The antibody response to HA stem elicited by H1-SS-np was significantly higher than that of trivalent inactivated influenza vaccine (TIV) in both mice and ferrets (FIG. 3b, right panel). Although a considerable response to ferritin was also observed (FIGS. 3a and 3b, left panel), previous studies have shown that immunization with bacterial ferritin does not induce immunity to autologous ferritin in mice, nor does it mitigate HA-specific antibody responses to subsequent immunizations. Measurement of serum neutralization activity (NT) using a highly sensitive HA-NA lentiviral reporter assay (Wei, C. J., et al. Sci. Transl. Med. 2, 24ra21 (2010)) revealed appreciable activity against the divergent H1N1 strains A/California/04/2009 (2009 CA) and A/Singapore/6/1986 (1986 SG) and the homologous 1999 NC strain in both mice and ferrets. However, NT against heterosubtypic H5N1 A/Vietnam/1203/2004 (H5N1 2004 VN), human origin H2N2 A/Canada/720/2005 (H2N2 2005 CA), H7N9 A/Anhui/1/2013 (H7N9 2013 AN) and H9N2 A/Hong Kong/1074/1999 (H9N2 1999 HK) was low or undetectable in both mice and ferrets (FIGS. 3a and 3c). The minimal heterosubtypic neutralization observed despite strong heterosubtypic antibody reactivity is likely due to the precise targeting of a single epitope region required for stem neutralization, making it more sensitive to minor structural differences than other parts of the HA stem which is 20-fold greater in surface area. TIV-immunized animals had the highest NT against homologous 1999 NC, detectable NT against the heterologous H1N1 strains, and no NT against heterosubtypic H5N1 in both mice and ferrets (FIG. 3b). As expected, TIV-immunized animals had significant hemagglutination inhibition (HA1) titers and NT activity elicited by H1-SS-np and H1-SS-np' was not associated with HA1.

Figure 4A:
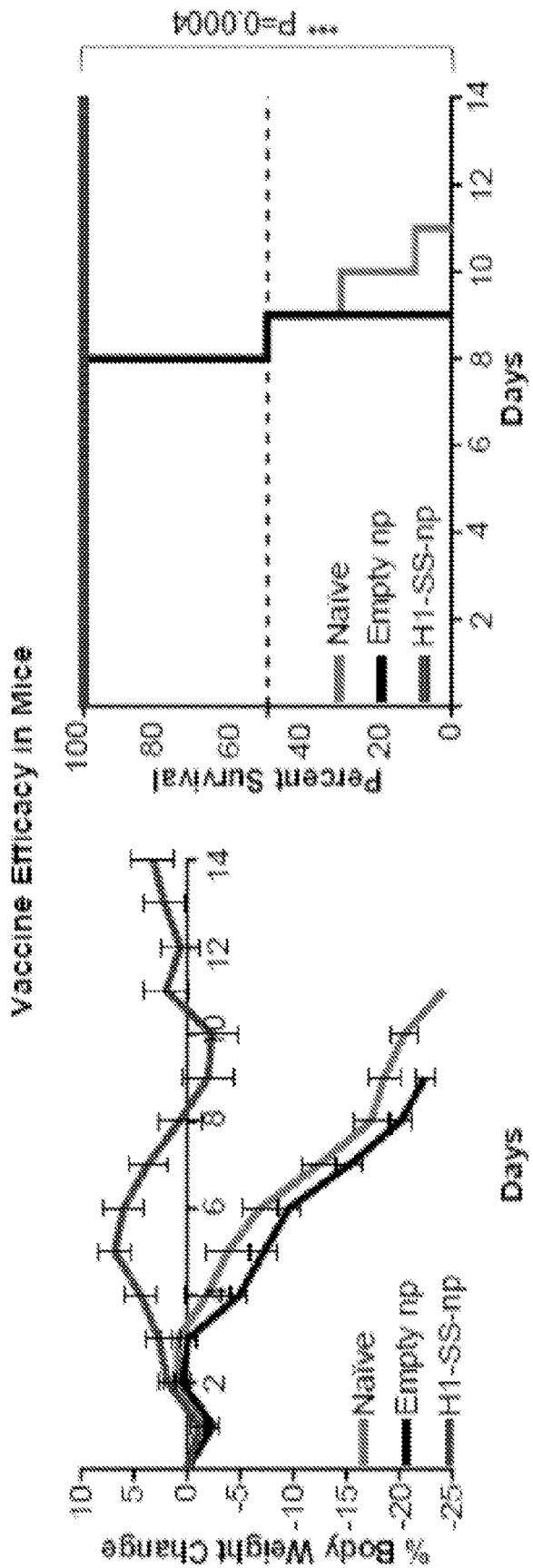
Figure 4B:
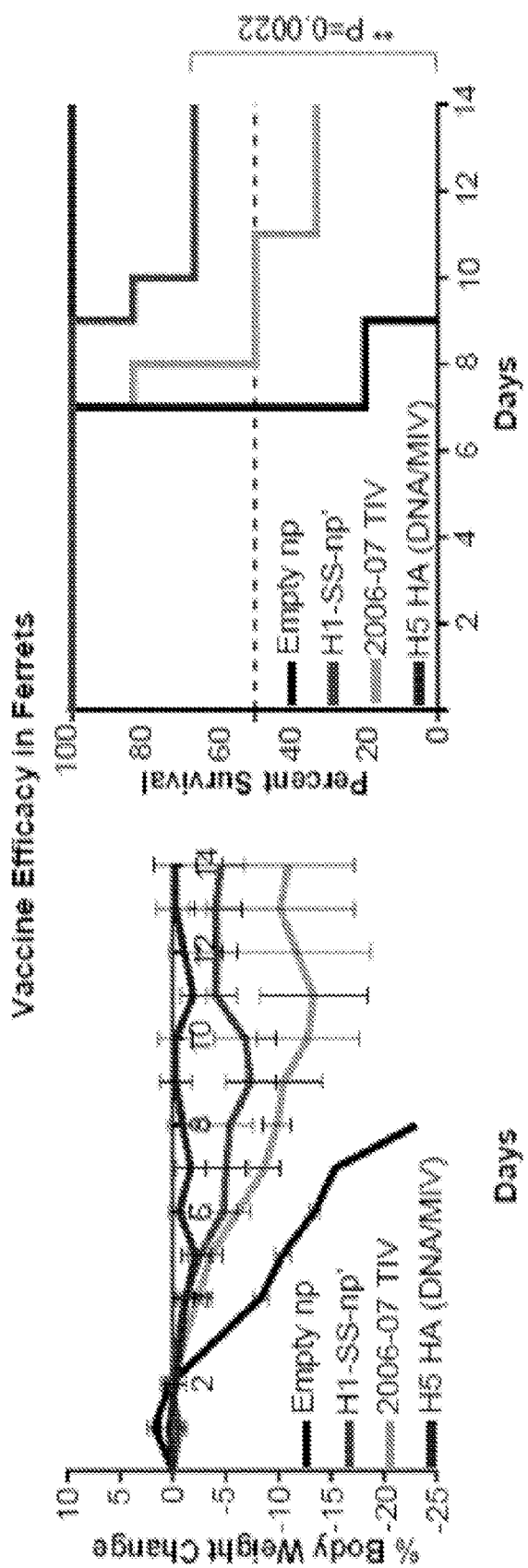

To assess protection, immunized mice and ferrets were challenged with a high lethal dose of highly pathogenic H5N1 2004 VN virus. All naïve mice and those immunized with empty np died and notably, all those immunized with H1-SS-np survived (FIG. 4a). All ferrets immunized with empty ferritin nanoparticles succumbed to infection, and all ferrets immunized with an H5N1 HA DNA/monovalent inactivated vaccine (MIV) prime-boost survived (FIG. 4b). Consistent with the mouse study, four out of six H1N1-based H1-SS-np'-immunized ferrets survived H5N1 challenge. Although two out of six TIV-immunized ferrets survived, one of the two survivors experienced severe weight loss (FIG. 4a), and there was no evidence of H5 serological response in the other survivor which had minimal weight loss, suggesting infection did not occur. Apart from one seronegative animal, the TIV-immunized group was not different in weight loss or fever compared to empty ferritin-np controls and showed greater illness as evidenced by post challenge activity scores than the H1-SS-np'-immunized ferrets. There was a considerable reduction in day 6 weight loss, fever and illness based on activity scores in the H1-SS-np'-immunized ferrets compared to empty ferritin-immunized controls (FIG. 4). The HA1 titers to H5N1 2004 VN present at day 14 post-challenge in the surviving ferrets indicates that while H1-SS-np' was able to protect against illness, it did not prevent infection. Tables 3 and 4 provide the summary of these immunization studies in the mice and ferrets.

TABLE 3

Post challenge sera HAI antibody titers to H1N1 1999 NC and H5N1 2004 VN in mice immunized with H1-SS-np.

| | H1-SS-np | |
|---|---|---|
| Mouse # | H1N1 1999 NC (Post challenge) | H5N1 2004 VN (Postchallenge) |
| 1 | <10 | 40 |
| 2 | <10 | 80 |
| 3 | <10 | 10 |
| 4 | <10 | 160 |
| 5* | N/A | N/A |
| 6 | <10 | 160 |
| 7 | <10 | <10 |
| 8 | <10 | <10 |
| 9 | <10 | 160 |
| 10 | <10 | <10 |

*This mouse died one day before challenge.

TABLE 4

Pre challenge HAI antibody titer to homologous H1N1 1999 NC and post challenge HAI antibody titer to challenge strain H5N1 2004 VN in ferrets immunized with indicated regimens.

| | H1N1 1999 NC (Pre Challenge) | | | | H5N1 2004 VN (post challenge) | | | |
|---|---|---|---|---|---|---|---|---|
| Ferret # | Empty np | H1-SS-np' | H5 HA (DNA/MIV) | 2006-07 TIV | Empty np | H1-SS-np' | H5 HA (DNA/MIV) | 2006-07 TIV |
| 1 | 10 | 10 | 10 | 640 | N/A | ≥1280 | <10 | 640 |
| 2 | 10 | 10 | 10 | 1280 | N/A | N/A | <10 | N/A |
| 3 | 10 | 10 | 10 | 2560 | N/A | ≥1280 | <10 | <10 |

TABLE 4-continued

Pre challenge HAI antibody titer to homologous H1N1 1999 NC
and post challenge HAI antibody titer to challenge strain
H5N1 2004 VN in ferrets immunized with indicated regimens.

| | H1N1 1999 NC (Pre Challenge) | | | | H5N1 2004 VN (post challenge) | | | |
|---|---|---|---|---|---|---|---|---|
| Ferret # | Empty np | H1-SS-np' | H5 HA (DNA/MIV) | 2006-07 TIV | Empty np | H1-SS-np' | H5 HA (DNA/MIV) | 2006-07 TIV |
| 4 | 10 | 10 | 10 | 1280 | N/A | ≥1280 | ≥1280 | N/A |
| 5 | 10 | 10 | 10 | 2560 | N/A | 640 | ≥1280 | N/A |
| 6 | N/A | 10 | 10 | 2560 | NA | N/A | ≥1280 | N/A |

Figure 4C:
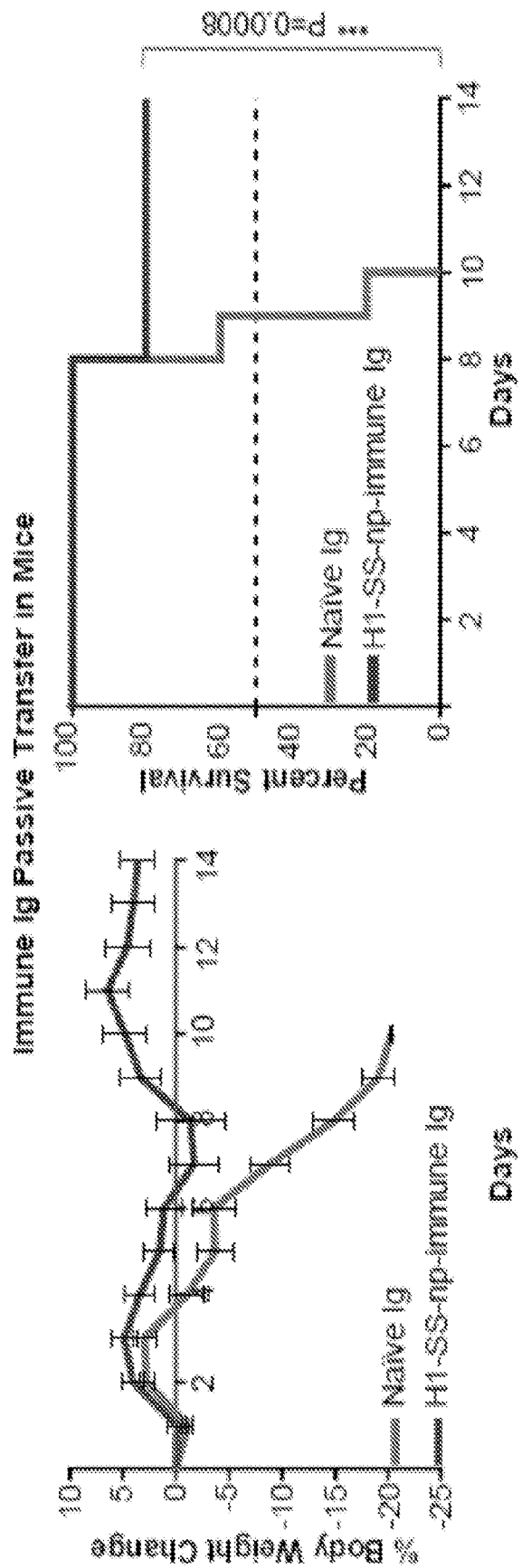
Figure 4D:
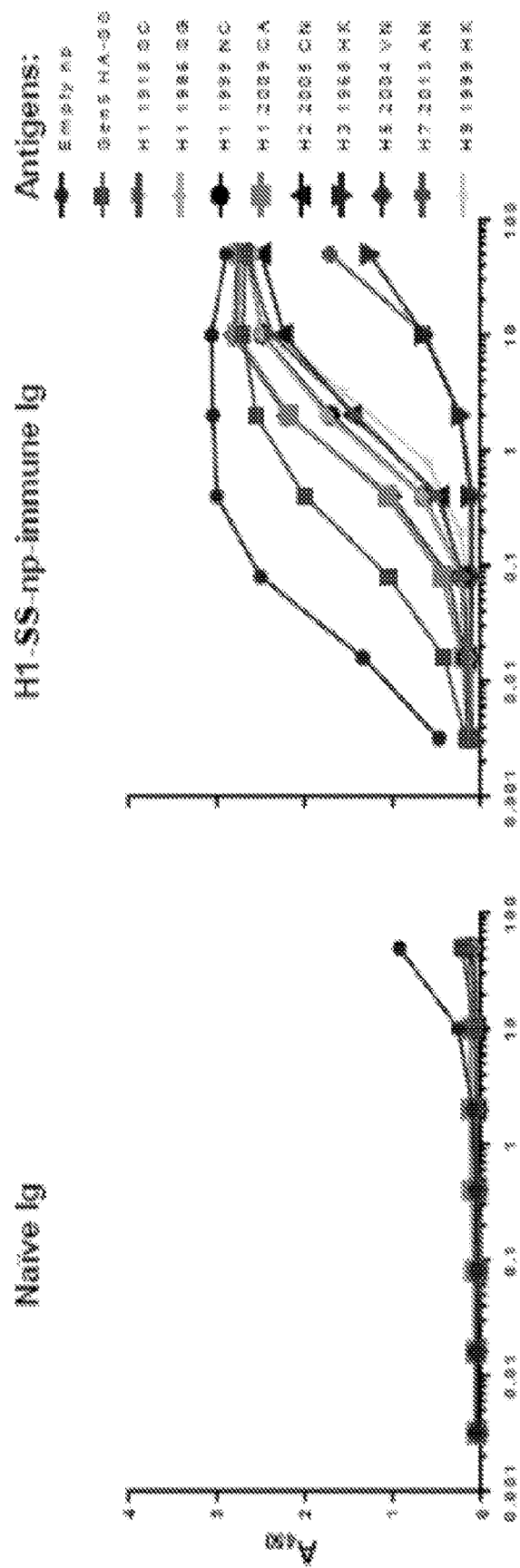
Figure 6:
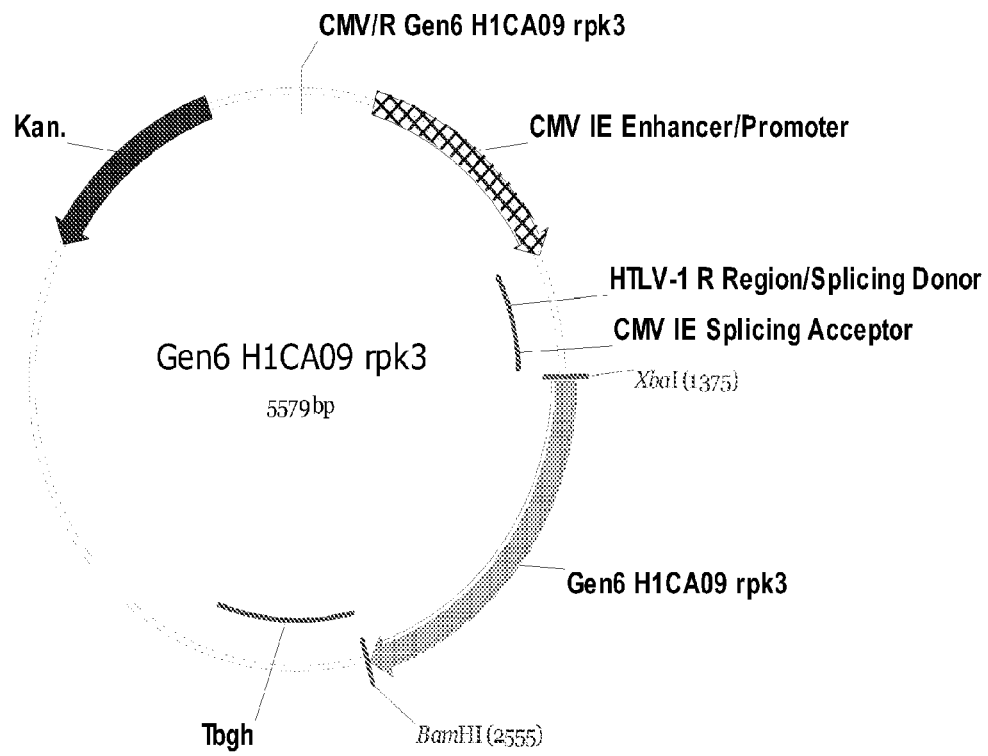
Figure 7:
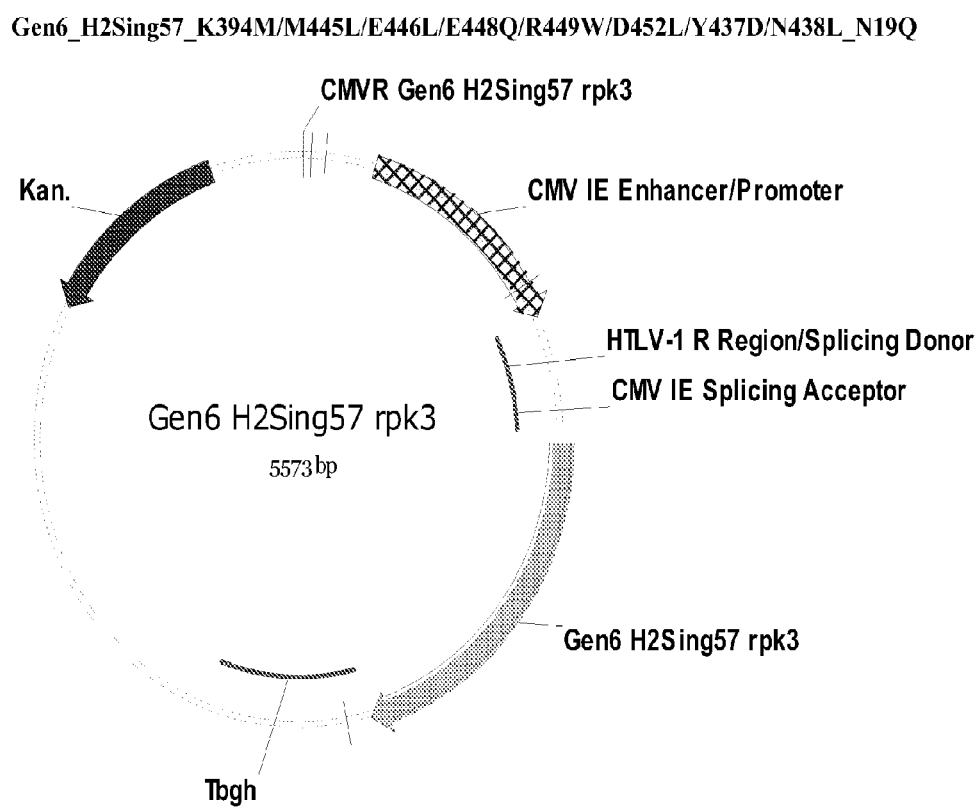
Figure 9:
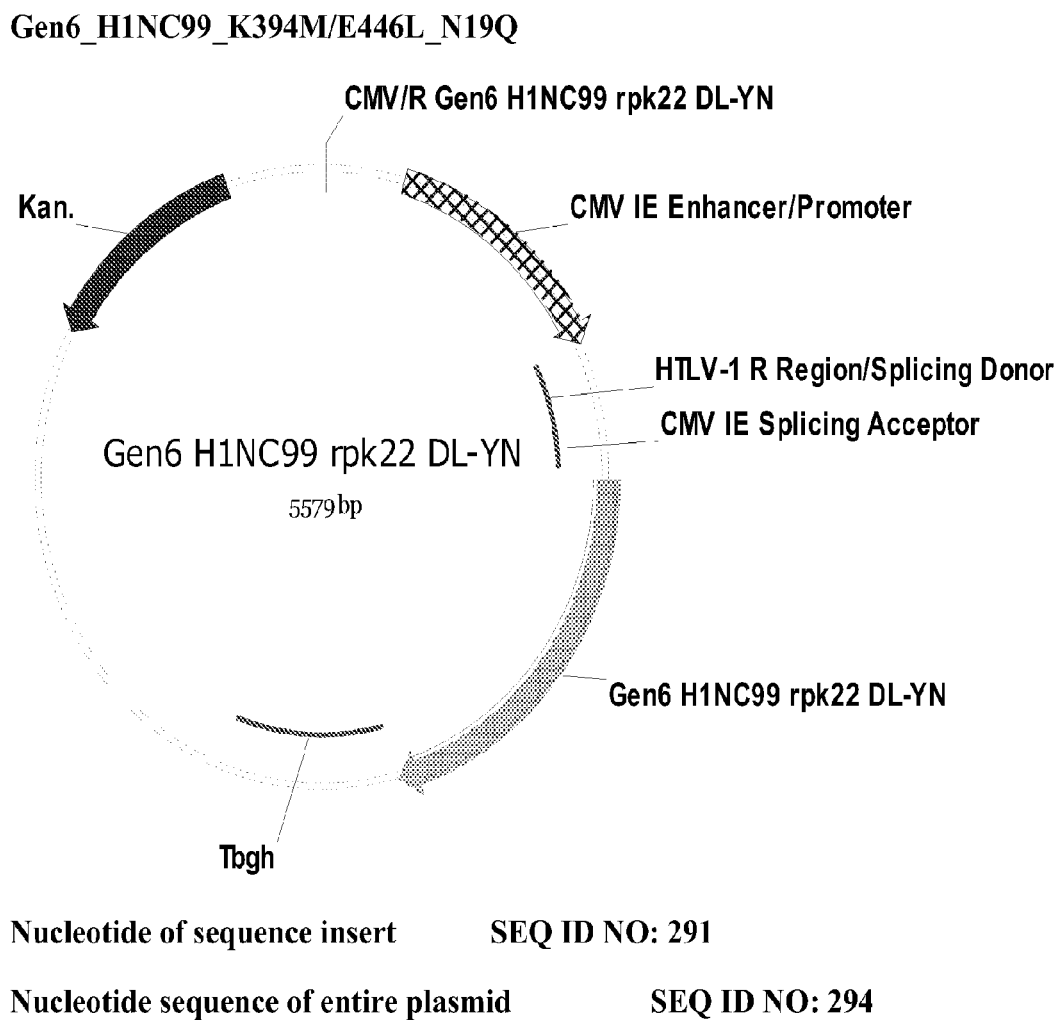
Figure 13:
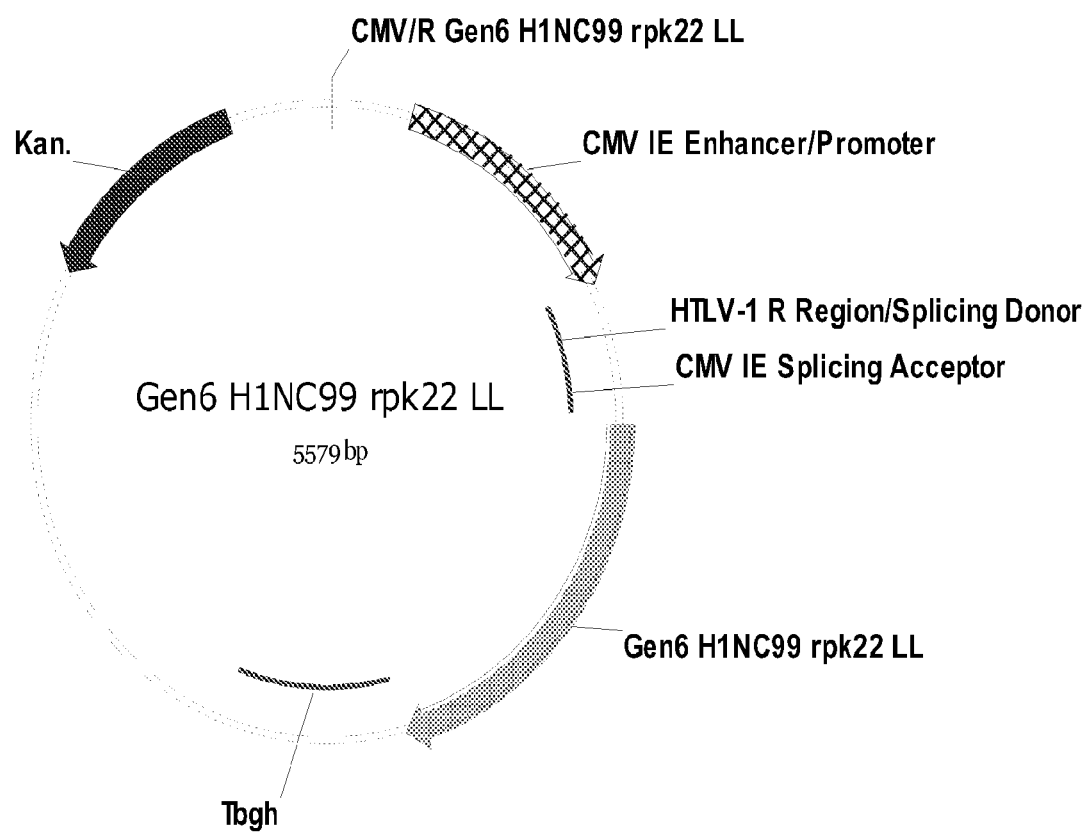
Figure 17:
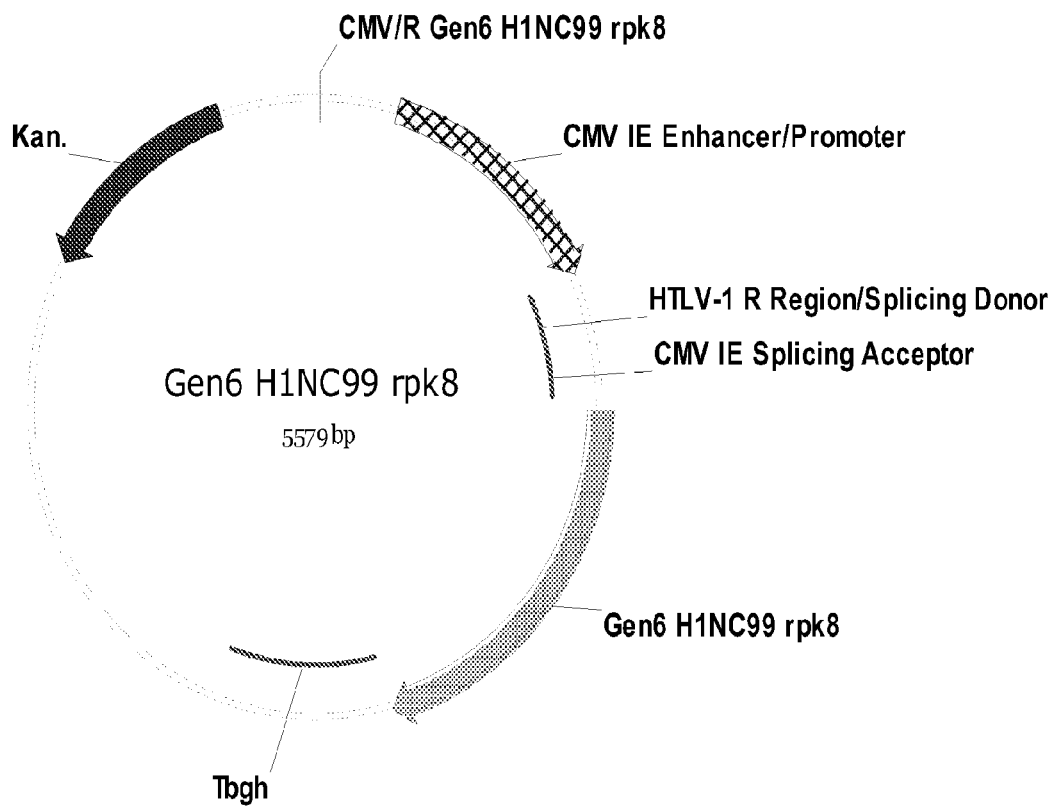

The negligible H5N1 NT activity elicited by H1-SS-np' (FIG. 3c) does not explain the heterosubtypic protection observed. However, there was a correlation between HA stem antibody titer and survival as well as between antibody titers and body weight in the H1-SS-np'-immunized ferrets. To further investigate this correlation, the inventors passively transferred H1-SS-np-immune Ig to naïve mice (10 mg/animal) 24 hour before challenge with a high lethal dose of H5N1 2004 VN virus. The transferred Ig had strong reactivity with the group 1 HA subtypes (H1, H2, H5, and H9), weaker binding to group 2 subtypes (H3 and H7), and minimal NT activity (FIGS. 4d and 4e). The IC50 neutralization titer of H1-SS-np immune Ig to diverse influenza pseudoviruses is shown in Table 5.

TABLE 5

$IC_{50}$ pseudovirus neutralization titer of H1-SS-np-immune Ig.

| Virus | H1N1 1986 SG | H1N1 1999 NC | H1N1 2009 CA | H2N2 2004 CN | H5N1 2004 VN | H7N9 2013 AN | H9N2 1999 HK |
|---|---|---|---|---|---|---|---|
| IC50 | 11 mg/ml | >50 mg/ml | >50 mg/ml | >50 mg/ml | >50 mg/ml | >50 mg/ml | >50 mg/ml |

While all the mice that received naïve Ig died from infection, eight out of ten mice that received immune Ig were completely protected from lethal H5N1 heterosubtypic challenge. Low sera reactivity to homologous H1 1999 NC HA in the two mice that died in the immune Ig group indicate they may not have received the appropriate Ig administration (FIG. 4c).

Together, these data show that antibody-mediated protection based on functional mechanisms other than neutralization such as antibody-dependent cell-mediated cytotoxicity (ADCC) or antibody-dependent complement-mediated lysis are responsible for protection elicited by H1-SS-np and H1-SS-np' immunizations. Influenza protection in mice by broadly neutralizing HA stem antibodies have been reported to be dependent on Fc interactions (DiLillo, et. al. Nat Med 20, 143-151 (2014)) and cross-reactive ADCC against influenza HA in the absence of neutralization has been reported in both human and macaque plasma (Jegaskanda, S., et al. J Immunol 190, 1837-1848 (2013); Jegaskanda, et al. J. Virol. 87, 5512-5522 (2013); Jegaskanda, et al. J Immunol 193, 469-475 (2014)). Consistent with these reports, the results presented herein suggest that HA stem-based influenza vaccines need not necessarily be focused on neutralizing epitopes to induce broad protection.

Using structure-based design and avoiding immunodominant responses to the HA head domain, combined with a nanoparticle antigen display platform, the inventors have successfully generated an HA stem-only nanoparticle vaccine immunogen that elicits antibody-mediated heterosubtypic protective immunity against H5N1 disease in ferrets. These results demonstrate that elicitation of non-neutralizing antibodies by an HA-stem-only nanoparticle vaccine can provide broad protection against severe disease and should be used to develop universal influenza vaccines.

SEQUENCE LISTING (401 sequences)

SEQ ID NO: 1 - DNA, 504 bp, Helicobacter pylori
atgctgtccgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 2 - protein, 168 aa, Helicobacter pylori
MLSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 3 - DNA, 504 bp, Helicobacter pylori
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcggacagcat

SEQ ID NO: 4 - DNA, 492 bp, Influenza A virus
atcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 5 - protein, 165 aa, Influenza A virus
DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 6 - DNA, 492 bp, Influenza A virus
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgat

SEQ ID NO: 7 - DNA, 1695 bp, Influenza A virus
atgaaggccaaactgctggtgctgctgtgtacctttaccgccacctacgccgacacaatctgtatcggctaccacgccaacaatagcaccgacaccgtggatacagtgctggagaagaacgtgaccgtgacccactctgtgaacctgctggaggacagccacaatggcaagctgtgtctgctgaaaggcattgcccctctgcagctgggcaattgttctgtggccggatggattctgggcaaccccgagtgtgagctgctgatttctaaggagagctggagctacatcgtggagacccccaatcctgagaatggcacctgctaccctggctacttcgccgattacgaggagctgcgcgagcagctgtctagcgtgtccagcttcgagagattcgagatcttccccaaggagtccagctggcctaatcacacagtgacaggcgtgtctgccagctgtagccacaacggcaaaagcagcttctaccggaacctgctgtggctgacaggcaagaatggcctgtaccccaacctgagcaagagctacgtgaacaacaaggaaaaggaagtgctggtgctgtggggagtgcaccaccctcccaacatcggaaatcagcgggccctgtaccacacagagaacgcctatgtgagcgtggtgtccagccactacagcagaagattcacccccgagatcgccaagagacccaaagtgagagaccaggagggccggatcaattactactggaccctgctggagcctggcgataccatcatcttcgaggccaacggcaatctgatcgccccttggtatgcctttgccctgagcagaggctttggcagcggcatcatcacaagcaacgcccccatggatgagtgtgatgccaagtgccagacacctcagggcgccatcaatagcagcctgcccttccagaatgtgcaccctgtgaccatcggcgagtgccccaagtatgtgagaagcgccaagctgagaatggtgaccggcctgagaaacatccctagcatccagagcagaggactgtttggagccatcgccggattcatcgagggaggatggacaggcatggtggatggctggtacggctaccaccaccagaatgagcagggctctggatatgccgccgatcagaagtctacccagaacgccatcaacggcatcaccaacaaggtgaacagcgtgatcgagaagatgaacacccagtttaccgctgtgggcaaggagttcaacaagctggagcggaggatggagaacctgaacaagaaggtggacgacggctttctggacatctggacctacaatgccgaactcctggtcctcctcgagaatgagaggaccctggacttccacgacagcaacgtgaagaacctgtatgagaaggtgaagagccagctgaagaacaacgccaaggagatcggcaacggctgcttcgagttctaccacaagtgtaacaacgagtgtatggagagcgtgaagaacggcacctacgactaccctaagtacagcgaggagagcaagctgaaccgggagaagatcgatggcgtgaagctggagagcatgggcgtgtatcagatcctggccatctacagcacagtggcctcttctctggtgctgctggtgtctctgggcgccatctccttttggatgtgctccaacggcagcctgcagtgcaggatctgtatc

SEQ ID NO: 8 - protein, 565 aa, Influenza A virus
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 9 - DNA, 1695 bp, Influenza A virus
gatacagatcctgcactgcaggctgccgttggagcacatccaaaaggagatggcgcccagagacaccagcagcaccagagaagaggccactgtgctgtagatggccaggatctgatacacgcccatgctctccagcttcacgccatcgatcttctcccggttcagcttgctctcctcgctgtacttagggtagtcgtaggtgccgttcttcacgctctccatacactcgttgttacacttgtggtagaactcgaagcagccgttgccgatctccttggcgttgttcttcagctggctcttcaccttctcatacaggttcttcacgttgctgtcgtggaagtccagggtcctctcattctcgaggaggaccaggagttcggcattgtaggtccagatgtccagaaagccgtcgtccaccttcttgttcaggttctccatcctccgctccagcttgttgaactccttgcccacagcggtaaactgggtgttcatcttctcgatcacgctgttcaccttgttggtgatgccgttgatggcgttctgggtagacttctgatcggcggcatatccagagccctgctcattctggtggtggtagccgtaccagccatccaccatgcctgtccatcctccctcgatgaatccggcgatggctccaaacagtcctctgctctggatgctagggatgtttctcaggccggtcaccattctcagcttggcgcttctcacatacttggggcactcgccgatggtcacagggtgcacattctggaagggcaggctgctattgatggcgccctgaggtgtctggcacttggcatcacactcatccatgggggcgttgcttgtgatgatgccgctgccaaagcctctgctcagggcaaaggcataccaaggggcgatcagattgccgttggcctcgaagatgatggtatcgccaggctccagcagggtccagtagtaattgatccggccctcctggtctctcactttgggtctcttggcgatctcgggggtgaatcttctgctgtagtggctggacaccacgctcacataggcgttctctgtgtggtacagggcccgctgatttccgatgttgggagggtggtgcactccccacagcaccagcacttccttttccttgttgttcacgtagctcttgctcaggttggggtacaggccattcttgcctgtcagccacagcaggttccggtagaagctgcttttgccgttgtggctacagctggcagacacgcctgtcactgtgtgattaggccagctggactccttggggaagatctcgaatctctcgaagctggacacgctagacagctgctcgcgcagctcctcgtaatcggcgaagtagccagggtagcaggtgccattctcaggattgggggtctccacgatgtagctccagctctccttagaaatcagcagctcacactcggggttgcccagaatccatccggccacagaacaattgcccagctgcagaggggcaatgcctttcagcagacacagcttgccattgtggctgtcctccagcaggttcacagagtgggtcacggtcacgttcttctccagcactgtatccacggtgtcggtgctattgttggcgtggtagccgatacagattgtgtcggcgtaggtggcggtaaaggtacacagcagcaccagcagtttggccttcat

SEQ ID NO: 10 - DNA, 1698 bp, Influenza A virus
atgaaggctattttggtcgtgctcctgtacacctttgccacagccaatgccgataccctttgtattggctaccatgcaaacaactctaccgatacggtcgacacggtgctcgaaaagaatgttactgtcacccactctgtgaacttgctggaggataaacacaatggcaagctctgcaaactgcgaggggtggctcccctgcatctgggaaaatgtaatattgccggctggatactgggtaatccagaatgcgaatccttgagtacggcatccagttggtcctatatcgtcgagaccccgtcaagtgacaatgggacctgctacccaggcgacttcattgattatgaagagctgagggagcagttgtcatccgtaagcagcttcgaaaggtttgagattttcccgaaaactagctcctggcccaatcatgactctaacaaaggagttactgcagcctgtcctcatgcgggcgcgaaaagcttctacaagaacctgatatggctcgtgaagaaaggcaattcatacccaaaactgtctaagagctacataaacgataaagggaaagaggttctggtgctttggggcatacaccacccatctacctcagccgaccagcagtctctgtatcagaacgccgacacatacgtgtttgtgggcagctcccgctattctaagaagttcaaacccgagatcgccatcagaccaaaggtgagagaccaggaaggaaggatgaattattactggaccttggtcgaacctggcgataagataacgtttgaggctacgggcaacctggtcgtgccgagatatgcttttgccatggagaggaatgcggggagcggaattatcatcagcgacactccagttcatgactgtaataccacatgtcagacaccgaagggcgccatcaacacgagcttgccctttcagaatatacatccaatcacaatcggaaaatgccccaagtacgtgaaaagcactaaactgagactcgccaccggactcaggaatatcccaagcatccagtcacggggtctgttcggcgctatcgccggatttattgaaggcggctggacggggatggtggacggttggtacggctaccatcatcaaaatgagcagggctccggatacgccgctgacctgaaatctacgcagaatgccatagatgagatcacaaacaaggtcaatagtgtgatagaaaaaatgaatactcagttcacagctgttggaaaggagtttaaccacctcgagaagcgaattgagaacctgaacaagaaggtggacgatggctttttggatatctggacgtataacgctgagctgcttgttctgctggagaacgaaagaacccttgactaccacgattccaacgtgaagaatctgtatgagaaagtgcgaagccagttgaaaaacaacgcaaaagaaataggcaacggctgtttcgagttctaccacaaatgcgataacacctgcatggagagtgtgaagaacggaacgtacgattatccaaaatactccgaggaggccaaactcaatagggaggagatagacggtgttaagctggagtccacacgcatctatcagattctggcgatctactctactgtggcttccagcctggtgctggtcgtttcccttggggcgatcagcttctggatgtgcagcaatggctccctgcaatgccgcatctgcatc

SEQ ID NO: 11 - protein, 566 aa, Influenza A virus
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 12 - DNA, 1698 bp, Influenza A virus
gatgcagatgcggcattgcagggagccattgctgcacatccagaagctgatcgccccaagggaaacgaccagcaccaggctggaagccacagtagagtagatcgccagaatctgatagatgcgtgtggactccagcttaacaccgtctatctcctccctattgagtttggcctcctcggagtattttggataatcgtacgttccgttcttcacactctccatgcaggtgttatcgcatttgtggtagaactcgaaacagccgttgcctatttcttttgcgttgtttttcaactggcttcgcactttctcatacagattcttcacgttggaatcgtggtagtcaagggttctttcgttctccagcagaacaagcagctcagcgttatacgtccagatatccaaaaagccatcgtccaccttcttgttcaggttctcaattcgcttctcgaggtggttaaactcctttccaacagctgtgaactgagtattcattttttctatcacactattgaccttgtttgtgatctcatctatggcattctgcgtagatttcaggtcagcggcgtatccggagccctgctcattttgatgatggtagccgtaccaaccgtccaccatccccgtccagccgccttcaataaatccggcgatagcgccgaacagaccccgtgactggatgcttgggatattcctgagtccggtggcgagtctcagtttagtgcttttcacgtacttggggcattttccgattgtgattggatgtatattctgaaagggcaagctcgtgttgatggcgcccttcggtgtctgacatgtggtattacagtcatgaactggagtgtcgctgatgataattccgctccccgcattcctctccatggcaaaagcatatctcggcacgaccaggttgcccgtagcctcaaacgttatcttatcgccaggttcgaccaaggtccagtaataattcatccttccttcctggtctctcacctttggtctgatggcgatctcgggtttgaacttcttagaatagcgggagctgcccacaaacacgtatgtgtcggcgttctgatacagagactgctggtcggctgaggtagatgggtggtgtatgccccaaagcaccagaacctctttccctttatcgtttatgtagctcttagacagttttgggtatgaattgcctttcttcacgagccatatcaggttcttgtagaagcttttcgcgcccgcatgaggacaggctgcagtaactcctttgttagagtcatgattgggccaggagctagttttcgggaaaatctcaaacctttcgaagctgcttacggatgacaactgctccctcagctcttcataatcaatgaagtcgcctgggtagcaggtcccattgtcacttgacggggtctcgacgatataggaccaactggatgccgtactcaaggattcgcattctggattacccagtatccagccggcaatattacattttcccagatgcaggggagccacccctcgcagtttgcagagcttgccattgtgtttatcctccagcaagttcacagagtgggtgacagtaacattcttttcgagcaccgtgtcgaccgtatcggtagagttgtttgcatggtagccaatacaaagggtatcggcattggctgtggcaaaggtgtacaggagcacgaccaaaatagccttcat

SEQ ID NO: 13 - DNA, 1683 bp, Influenza A virus
atggccatcatctacctgatcctgctgtttacagctgtgagaggcgaccagatctgtatcggctaccacgccaacaatagcaccgagaaggtggacaccatcctggagagaaacgtgacagtgacccacgccaaggacatcctggaaaagacccacaacggcaagctgtgtaagctgaacggcatccctcctctggaactgggcgattgttctatcgccggatggctgctgggaaaccccgagtgtgataggctgctgtctgtgcctgagtggagctacatcatggagaaggagaaccctagggacggcctgtgttaccctggcagcttcaacgattacgaggagctgaagcacctgctgtctagcgtgaagcacttcgagaaggtgaagatcctgcccaaggacagatggacccagcacacaacaacaggaggaagcagagcctgcgccgtgtctggcaaccccagcttcttccggaatatggtgtggctgaccaagaagggcagcaattaccctgtggcccagggcagctacaataataccagcggcgagcagatgctgatcatctggggagtgcaccaccctaatgacgagaccgagcagagaaccctgtaccagaatgtgggcacctacgtgtctgtgggcaccagcaccctgaataagagaagcacccccgagattgccacaagacccaaggtgaacggccagggaggaagaatggagttcagctggaccctgctggatatgtgggacaccatcaactttgagagcaccggcaatctgatcgcccctgagtacggcttcaagatcagcaagagaggcagcagcggcatcatgaaaaccgagggcaccctggagaattgtgagaccaagtgccagacacctctgggcgccatcaataccaccctgcccttccacaatgtgcaccctctgaccatcggcgagtgccctaagtatgtgaagagcgagaagctggtgctggccacaggactgagaaacgtgccccagatcgagagcagaggcctgtttggagccatcgccggattcatcgagggaggatggcagggaatggtcgatggctggtacggctaccaccacagcaatgatcagggctctggctatgccgccgataaggagtctacccagaaggcctttgacggcatcaccaacaaggtgaacagcgtgatcgagaagatgaacacccagtttgaggctgtgggcaaggagtttagcaacctggagcggagactggagaacctgaacaagaagatggaggacggcttcctggatgtgtggacctacaatgccgaactgctggtgctgatggagaatgagcggaccctggacttccacgacagcaacgtgaagaacctgtacgacaaagtgaggatgcagctgagggacaacgtgaaggaactgggcaatggctgcttcgagttctaccacaagtgtgacgacgagtgtatgaactccgtgaagaacggcacctacgactaccctaagtacgaggaggagagcaagctgaaccggaacgagatcaagggcgtgaagctgtctagcatgggcgtgtatcagatcctggccatctatgccacagtggccggatctctgagcctggcaattatgatggctggaatcagcttctggatgtgctccaatggcagcctgcagtgccggatctgt

SEQ ID NO: 14 - protein, 564 aa, Influenza A virus
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDYHIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 15 - DNA, 1683 bp, Influenza A virus
acagatccggcactgcaggctgccattggagcacatccagaagctgattccagccatcataattgccaggctcagagatccggccactgtggcatagatggccaggatctgatacacgcccatgctagacagcttcacgcccttgatctcgttccggttcagcttgctctcctcctcgtacttagggtagtcgtaggtgccgttcttcacggagttcatacactcgtcgtcacacttgtggtagaactcgaagcagccattgcccagttccttcacgttgtccctcagctgcatcctcactttgtcgtacaggttcttcacgttgctgtcgtggaagtccagggtccgctcattctccatcagcaccagcagttcggcattgtaggtccacacatccaggaagccgtcctccatcttcttgttcaggttctccagtctccgctccaggttgctaaactccttgcccacagcctcaaactgggtgttcatcttctcgatcacgctgttcaccttgttggtgatgccgtcaaaggccttctgggtagactccttatcggcggcatagccagagccctgatcattgctgtggtggtagccgtaccagccatcgaccattccctgccatcctccctcgatgaatccggcgatggctccaaacaggcctctgctctcgatctggggcacgtttctcagtcctgtggccagcaccagcttctcgctcttcacatacttagggcactcgccgatggtcagagggtgcacattgtggaagggcagggtggtattgatggcgcccagaggtgtctggcacttggtctcacaattctccagggtgccctcggttttcatgatgccgctgctgcctctcttgctgatcttgaagccgtactcaggggcgatcagattgccggtgctctcaaagttgatggtgtcccacatatccagcagggtccagctgaactccattcttcctccctggccgttcaccttgggtcttgtggcaatctcgggggtgcttctcttattcagggtgctggtgcccacagacacgtaggtgcccacattctggtacagggttctctgctcggtctcgtcattagggtggtgcactccccagatgatcagcatctgctcgccgctggtattattgtagctgccctgggccacagggtaattgctgcccttcttggtcagccacaccatattccggaagaagctggggttgccagacacggcgcaggctctgcttcctcctgttgttgtgtgctgggtccatctgtccttgggcaggatcttcaccttctcgaagtgcttcacgctagacagcaggtgcttcagctcctcgtaatcgttgaagctgccagggtaacacaggccgtccctagggttctccttctccatgatgtagctccactcaggcacagacagcagcctatcacactcggggtttcccagcagccatccggcgatagaacaatcgcccagttccagaggagggatgccgttcagcttacacagcttgccgttgtgggtcttttccaggatgtccttggcgtgggtcactgtcacgtttctctccaggatggtgtccaccttctcggtgctattgttggcgtggtagccgatacagatctggtcgcctctcacagctgtaaacagcaggatcaggtagatgatggccat

SEQ ID NO: 16 - DNA, 1704 bp, Influenza A virus
atggaaaagatcgtgctgctgctggccattgtgagcctggtgaagagcgaccagatctgcattggctaccacgccaacaatagcacagagcaggtggacaccatcatggaaaaaaacgtgaccgtgacccacgctcaggacatcctggaaaagacccacaacggcaagctgtgtgatctggacggcgtgaagcctctgatcctgagagattgtagcgtggctggatggctgctgggcaaccctatgtgcgacgagttcatcaacgtgcccgagtggagctatatcgtggagaaggccaaccccaccaacgatctgtgttaccccggcagcttcaacgattacgaggaactgaagcacctgctgtcccggatcaaccacttcgagaagatccagatcatccccaagtcctcttggagcgatcacgaagcctctagcggagtgtctagcgcctgtccttacctgggcagccccagcttcttcagaaacgtggtgtggctgatcaagaagaacagcacctaccccaccatcaagaagagctacaacaacaccaaccaggaagatctgctggtcctgtggggaatccaccaccctaatgatgccgccgagcagaccagactgtaccagaaccccaccacctatatcagcatcggcaccagcaccctgaatcagagactggtgcccaagatcgccaccagatccaaggtgaacggccagagcggcaggatggaattcttctggaccatcctgaagcccaacgacgccatcaacttcgagagcaacggcaactttatcgcccctgagtacgcctacaagatcgtgaagaagggcgacagcgccatcatgaagagcgagctggaatacggcaactgcaacaccaagtgccagacacctatgggcgccatcaacagcagcatgcccttccacaacatccaccctctgaccatcggcgagtgccctaagtacgtgaagagcaacagactggtgctggccacaggcctgagaaatagcccccagcgggagagcagaagaaagaagaggggcctgtttggagccatcgccggctttattgaaggcggctggcagggaatggtggatggctggtacggctaccaccacagcaatgagcagggctctggatatgccgccgacaaagagtctacccagaaggccatcgacggcgtcaccaacaaggtgaacagcatcatcgacaagatgaacacccagttcgaggctgtgggcagagagttcaacaacctggaacggcggatcgagaacctgaacaagaaaatggaagatggcttcctggatgtgtggacctacaatgccgaactgctggtgctgatggaaaacgagcggaccctggacttccacgacagcaacgtgaagaacctgtacgacaaagtgcggctgcagctgagagacaacgccaaagagctgggcaacggctgcttcgagttctaccacaagtgcgacaacgagtgcatggaaagcatccggaacggcacctacaactaccctcagtacagcgaggaagccaggctgaagagggaagagatcagcggcgtgaaactggaatccatcggcacctaccagatcctgagcatctacagcacagtggcctcttctctggccctggccattatgatggccggactgagcctgtggatgtgcagcaatggcagcctgcagtgcaggatctgcatc

SEQ ID NO: 17 - protein, 568 aa, Influenza A virus
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 18 - DNA, 1704 bp, Influenza A virus
gatgcagatcctgcactgcaggctgccattgctgcacatccacaggctcagtccggccatcataatggccagggccagagaagaggccactgtgctgtagatgctcaggatctggtaggtgccgatggattccagtttcacgccgctgatctcttccctcttcagcctggcttcctcgctgtactgagggtagttgtaggtgccgttccggatgctttccatgcactcgttgtcgcacttgtggtagaactcgaagcagccgttgcccagctctttggcgttgtctctcagctgcagccgcactttgtcgtacaggttcttcacgttgctgtcgtggaagtccagggtccgctcgttttccatcagcaccagcagttcggcattgtaggtccacacatccaggaagccatcttccattttcttgttcaggttctcgatccgccgttccaggttgttgaactctctgcccacagcctcgaactgggtgttcatcttgtcgatgatgctgttcaccttgttggtgacgccgtcgatggccttctgggtagactctttgtcggcggcatatccagagccctgctcattgctgtggtggtagccgtaccagccatccaccattccctgccagccgccttcaataaagccggcgatggctccaaacaggcccctcttctttcttctgctctcccgctgggggctatttctcaggcctgtggccagcaccagtctgttgctcttcacgtacttagggcactcgccgatggtcagagggtggatgttgtggaagggcatgctgctgttgatggcgcccataggtgtctggcacttggtgttgcagttgccgtattccagctcgctcttcatgatggcgctgtcgcccttcttcacgatcttgtaggcgtactcaggggcgataaagttgccgttgctctcgaagttgatggcgtcgttgggcttcaggatggtccagaagaattccatcctgccgctctggccgttcaccttggatctggtggcgatcttgggcaccagtctctgattcagggtgctggtgccgatgctgatataggtggtggggttctggtacagtctggtctgctcggcggcatcattagggtggtggattccccacaggaccagcagatcttcctggttggtgttgttgtagctcttcttgatggtggggtaggtgctgttcttcttgatcagccacaccacgtttctgaagaagctggggctgcccaggtaaggacaggcgctagacactccgctagaggcttcgtgatcgctccaagaggacttggggatgatctggatcttctcgaagtggttgatccgggacagcaggtgcttcagttcctcgtaatcgttgaagctgccggggtaacacagatcgttggtggggttggccttctccacgatatagctccactcgggcacgttgatgaactcgtcgcacatagggttgcccagcagccatccagccacgctacaatctctcaggatcagaggcttcacgccgtccagatcacacagcttgccgttgtgggtcttttccaggatgtcctgagcgtgggtcacggtcacgtttttttccatgatggtgtccacctgctctgtgctattgttggcgtggtagccaatgcagatctggtcgctcttcaccaggctcacaatggccagcagcagcacgatcttttccat

SEQ ID NO: 19 - DNA, 147 bp, Influenza A virus
atgaaggccaaactgctggtgctgctgtgtacctttaccgccacctacgccgacacaatctgtatcggctaccacgccaacaatagcaccgacaccgtggatacagtgctggagaagaacgtgaccgtgacccactctgtgaacctg

SEQ ID NO: 20 - protein, 49 aa, Influenza A virus
MKAKLLVLLCTFTATYADTICIGYHANNSTDTVDTVLEKNVTVTHSVNL

SEQ ID NO: 21 - DNA, 147 bp, Influenza A virus
caggttcacagagtgggtcacggtcacgttcttctccagcactgtatccacggtgtcggtgctattgttggcgtggtagccgatacagattgtgtcggcgtaggtggcggtaaaggtacacagcagcaccagcagtttggccttcat

SEQ ID NO: 22 - DNA, 678 bp, Influenza A virus
gatgccaagtgccagacacctcagggcgccatcaatagcagcctgcccttccagaatgtgcaccctgtgaccatcggcgagtgccccaagtatgtgagaagcgccaagctgagaatggtgaccggcctgagaaacatccctagcatccagagcagaggactgtttggagccatcgccggattcatcgagggaggatggacaggcatggtggatggctggtacggctaccaccaccagaatgagcagggctctggatatgccgccgatcagaagtctacccagaacgccatcaacggcatcaccaacaaggtgaacagcgtgatcgagaagatgaacacccagtttaccgctgtgggcaaggagttcaacaagctggagcggaggatggagaacctgaacaagaaggtggacgacggctttctggacatctggacctacaatgccgaactcctggtcctcctcgagaatgagaggaccctggacttccacgacagcaacgtgaagaacctgtatgagaaggtgaagagccagctgaagaacaacgccaaggagatcggcaacggctgcttcgagttctaccacaagtgtaacaacgagtgtatggagagcgtgaagaacggcacctacgactaccctaagtacagcgaggagagcaagctgaaccgggagaagatcgat

SEQ ID NO: 23 - protein, 226 aa, Influenza A virus
DAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKID

SEQ ID NO: 24 - DNA, 678 bp, Influenza A virus
atcgatcttctcccggttcagcttgctctcctcgctgtacttagggtagtcgtaggtgccgttcttcacgctctccatacactcgttgttacacttgtggtagaactcgaagcagccgttgccgatctccttggcgttgttcttcagctggctcttcaccttctcatacaggttcttcacgttgctgtcgtggaagtccagggtcctctcattctcgaggaggaccaggagttcggcattgtaggtccagatgtccagaaagccgtcgtccaccttcttgttcaggttctccatcctccgctccagcttgttgaactccttgcccacagcggtaaactgggtgttcatcttctcgatcacgctgttcaccttgttggtgatgccgttgatggcgttctgggtagacttctgatcggcggcatatccagagccctgctcattctggtggtggtagccgtaccagccatccaccatgcctgtccatcctccctcgatgaatccggcgatggctccaaacagtcctctgctctggatgctagggatgtttctcaggccggtcaccattctcagcttggcgcttctcacatacttggggcactcgccgatggtcacagggtgcacattctggaagggcaggctgctattgatggcgccctgaggtgtctggcacttggcatc

SEQ ID NO: 25 - DNA, 576 bp, Influenza A virus
gatgccaagtgccagacacctcagggcgccatcaatagcagcctgcccttccagaatgtgcaccctgtgaccatcggcgagtgccccaagtatgtgagaagcgccaagctgagaatggtgaccggcctgagaaacatccctagcatccagagcagaggactgtttggagccatcgccggattcatcgagggaggatggacaggcatggtggatggctggtacggctaccaccaccagaatgagcagggctctggatatgccgccgatcagaagtctacccagaacgccatcaacggcatcaccaacaaggtgaacagcgtgatcgagaagatgtacaatgccgaactcctggtcctcctcgagaatgagaggaccctggacttccacgacagcaacgtgaagaacctgtatgagaaggtgaagagccagctgaagaacaacgccaaggagatcggcaacggctgcttcgagttctaccacaagtgtaacaacgagtgtatggagagcgtgaagaacggcacctacgactaccctaagtacagcgaggagagcaagctgaaccgggagaagatcgat

SEQ ID NO: 26 - protein, 193 aa, Influenza A virus
DAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMTYNAELLVLLENERTLDFHDSNVKNLYEKVKSQLKNNAKEIGNGCFEFYHKCNNECMESVKNGTYDYPKYSEESKLNREKID

SEQ ID NO: 27 - DNA, 576 bp, Influenza A virus
atcgatcttctcccggttcagcttgctctcctcgctgtacttagggtagtcgtaggtgccgttcttcacgctctccatacactcgttgttacacttgtggtagaactcgaagcagccgttgccgatctccttggcgttgttcttcagctggctcttcaccttctcatacaggttcttcacgttgctgtcgtggaagtccagggtcctctcattctcgaggaggaccaggagttcggcattgtacatcttctcgatcacgctgttcaccttgttggtgatgccgttgatggcgttctgggtagacttctgatcggcggcatatccagagccctgctcattctggtggtggtagccgtaccagccatccaccatgcctgtccatcctccctcgatgaatccggcgatggctccaaacagtcctctgctctggatgctagggatgtttctcaggccggtcaccattctcagcttggcgcttctcacatacttggggcactcgccgatggtcacagggtgcacattctggaagggcaggctgctattgatggcgccctgaggtgtctggcacttggcatc

SEQ ID NO: 28 - DNA, 570 bp, Influenza A virus
ctgagaatggtgaccggcctgagaaacatccctagcatccagagcagaggactgtttggagccatcgccggattcatcgagggaggatggacaggcatggtggatggctggtacggctaccaccaccagaatgagcagggctctggatatgccgccgatcagaagtctacccagaacgccatcaacggcatcaccaacaaggtgaacagcgtgatcgagaagatgaacacccagtttaccgctgtgggcaaggagttcaacaagctggagcggaggatggagaacctgaacaagaaggtggacgacggctttctggacatctggacctacaatgccgaactcctggtcctcctcgagaatgagaggaccctggacttccacgacagcaacgtgaagaacctgtatgagaaggtgaagagccagctgaagaacaacgccaaggagatcggcaacggctgcttcgagttctaccacaagtgtaacaacgagtgtatggagagcgtgaagaacggcacctacgactaccctaagtacagcgaggagagcaagctgaaccgggagaagatcgat

SEQ ID NO: 29 - protein, 194 aa, Influenza A virus
LRMVTGLRNIPQRETSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKID

SEQ ID NO: 30 - DNA, 570 bp, Influenza A virus
atcgatcttctcccggttcagcttgctctcctcgctgtacttagggtagtcgtaggtgccgttcttcacgctctccatacactcgttgttacacttgtggtagaactcgaagcagccgttgccgatctccttggcgttgttcttcagctggctcttcaccttctcatacaggttcttcacgttgctgtcgtggaagtccagggtcctctcattctcgaggaggaccaggagttcggcattgtaggtccagatgtccagaaagccgtcgtccaccttcttgttcaggttctccatcctccgctccagcttgttgaactccttgcccacagcggtaaactgggtgttcatcttctcgatcacgctgttcaccttgttggtgatgccgttgatggcgttctgggtagacttctgatcggcggcatatccagagccctgctcattctggtggtggtagccgtaccagccatccaccatgcctgtccatcctccctcgatgaatccggcgatggctccaaacagtcctctgctctggatgctagggatgtttctcaggccggtcaccattctcag

SEQ ID NO: 31 - DNA, 468 bp, Influenza A virus
ctgagaatggtgaccggcctgagaaacatccctagcatccagagcagaggactgtttggagccatcgccggattcatcgagggaggatggacaggcatggtggatggctggtacggctaccaccaccagaatgagcagggctctggatatgccgccgatcagaagtctacccagaacgccatcaacggcatcaccaacaaggtgaacagcgtgatcgagaagatgtacaatgccgaactcctggtcctcctcgagaatgagaggaccctggacttccacgacagcaacgtgaagaacctgtatgagaaggtgaagagccagctgaagaacaacgccaaggagatcggcaacggctgcttcgagttctaccacaagtgtaacaacgagtgtatggagagcgtgaagaacggcacctacgactaccctaagtacagcgaggagagcaagctgaaccgggagaagatcgat

SEQ ID NO: 32 - protein, 157 aa, Influenza A virus
LRMVTGLRNIPQRETRGLFGAIAGFIEGGWTGMVDGWYGYHHQNEQGSGYAADQKSTQNAINGITNKVNSVIEKMTYNAELLVLLENERTLDFHDSNVKNLYEKVKSQLKNNAKEIGNGCFEFYHKCNNECMESVKNGTYDYPKYSEESKLNREKID

SEQ ID NO: 33 - DNA, 468 bp, Influenza A virus
atcgatcttctcccggttcagcttgctctcctcgctgtacttagggtagtcgtaggtgccgttcttcacgctctccatacactcgttgttacacttgtggtagaactcgaagcagccgttgccgatctccttggcgttgttcttcagctggctcttcaccttctcatacaggttcttcacgttgctgtcgtggaagtccagggtcctctcattctcgaggaggaccaggagttcggcattgtacatcttctcgatcacgctgttcaccttgttggtgatgccgttgatggcgttctgggtagacttctgatcggcggcatatccagagccctgctcattctggtggtggtagccgtaccagccatccaccatgcctgtccatcctccctcgatgaatccggcgatggctccaaacagtcctctgctctggatgctagggatgtttctcaggccggtcaccattctcag

SEQ ID NO: 34 - DNA, 147 bp, Influenza A virus
atgaaggctattttggtcgtgctcctgtacacctttgccacagccaatgccgataccctttgtattggctaccatgcaaacaactctaccgatacggtcgacacggtgctcgaaaagaatgttactgtcacccactctgtgaacttg

SEQ ID NO: 35 - protein, 49 aa, Influenza A virus
MKAILVVLLYTFATANADTLCIGYHANNSTDTVDTVLEKNVTVTHSVNL

SEQ ID NO: 36 - DNA, 147 bp, Influenza A virus
caagttcacagagtgggtgacagtaacattcttttcgagcaccgtgtcgaccgtatcggtagagttgtttgcatggtagccaatacaaagggtatcggcattggctgtggcaaaggtgtacaggagcacgaccaaaatagccttcat

SEQ ID NO: 37 - DNA, 672 bp, Influenza A virus
acatgtcagacaccgaagggcgccatcaacacgagcttgccctttcagaatatacatccaatcacaatcggaaaatgccccaagtacgtgaaaagcactaaactgagactcgccaccggactcaggaatatcccaagcatccagtcacggggtctgttcggcgctatcgccggatttattgaaggcggctggacggggatggtggacggttggtacggctaccatcatcaaaatgagcagggctccggatacgccgctgacctgaaatctacgcagaatgccatagatgagatcacaaacaaggtcaatagtgtgatagaaaaaatgaatactcagttcacagctgttggaaaggagtttaaccacctcgagaagcgaattgagaacctgaacaagaaggtggacgatggctttttggatatctggacgtataacgctgagctgcttgttctgctggagaacgaaagaacccttgactaccacgattccaacgtgaagaatctgtatgagaaagtgcgaagccagttgaaaaacaacgcaaaagaaataggcaacggctgtttcgagttctaccacaaatgcgataacacctgcatggagagtgtgaagaacggaacgtacgattatccaaaatactccgaggaggccaaactcaatagggaggagatagac

SEQ ID NO: 38 - protein, 224 aa, Influenza A virus
TCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEID

SEQ ID NO: 39 - DNA, 672 bp, Influenza A virus
gtctatctcctccctattgagtttggcctcctcggagtattttggataatcgtacgttccgttcttcacactctccatgcaggtgttatcgcatttgtggtagaactcgaaacagccgttgcctatttcttttgcgttgtttttcaactggcttcgcactttctcatacagattcttcacgttggaatcgtggtagtcaagggttctttcgttctccagcagaacaagcagctcagcgttatacgtccagatatccaaaaagccatcgtccaccttcttgttcaggttctcaattcgcttctcgaggtggttaaactcctttccaacagctgtgaactgagtattcattttttctatcacactattgaccttgtttgtgatctcatctatggcattctgcgtagatttcaggtcagcggcgtatccggagccctgctcattttgatgatggtagccgtaccaaccgtccaccatccccgtccagccgccttcaataaatccggcgatagcgccgaacagaccccgtgactggatgcttgggatattcctgagtccggtggcgagtctcagtttagtgcttttcacgtacttggggcattttccgattgtgattggatgtatattctgaaagggcaagctcgtgttgatggcgcccttcggtgtctgacatgt

SEQ ID NO: 40 - DNA, 573 bp, Influenza A virus
acatgtcagacaccgaagggcgccatcaacacgagcttgccctttcagaatatacatccaatcacaatcggaaaatgccccaagtacgtgaaaagcactaaactgagactcgccaccggactcaggaatatcccaagcatccagtcacggggtctgttcggcgctatcgccggatttattgaaggcggctggacggggatggtggacggttggtacggctaccatcatcaaaatgagcagggctccggatacgccgctgacctgaaatctacgcagaatgccatagatgagatcacaaacaaggtcaatagtgtgatagaaaaaatgacgtataacgctgagctgcttgttctgctggagaacgaaagaacccttgactaccacgattccaacgtgaagaatctgtatgagaaagtgcgaagccagttgaaaaacaacgcaaaagaaataggcaacggctgtttcgagttctaccacaaatgcgataacacctgcatggagagtgtgaagaacggaacgtacgattatccaaaatactccgaggaggccaaactcaatagggaggagatagac

SEQ ID NO: 41 - protein, 191 aa, Influenza A virus
TCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMTYNAELLVLLENERTLDYHDSNVKNLYEKVRSQLKNNAKEIGNGCFEFYHKCDNTCMESVKNGTYDYPKYSEEAKLNREEID

SEQ ID NO: 42 - DNA, 573 bp, Influenza A virus
gtctatctcctccctattgagtttggcctcctcggagtattttggataatcgtacgttccgttcttcacactctccatgcaggtgttatcgcatttgtggtagaactcgaaacagccgttgcctatttcttttgcgttgtttttcaactggcttcgcactttctcatacagattcttcacgttggaatcgtggtagtcaagggttctttcgttctccagcagaacaagcagctcagcgttatacgtcattttttctatcacactattgaccttgtttgtgatctcatctatggcattctgcgtagatttcaggtcagcggcgtatccggagccctgctcattttgatgatggtagccgtaccaaccgtccaccatccccgtccagccgccttcaataaatccggcgatagcgccgaacagaccccgtgactggatgcttgggatattcctgagtccggtggcgagtctcagtttagtgcttttcacgtacttggggcattttccgattgtgattggatgtatattctgaaagggcaagctcgtgttgatggcgcccttcggtgtctgacatgt

SEQ ID NO: 43 - DNA, 507 bp, Influenza A virus
ctgagactcgccaccggactcaggaatatcccaagcatccagtcacggggtctgttcggcgctatcgccggatttattgaaggcggctggacggggatggtggacggttggtacggctaccatcatcaaaatgagcagggctccggatacgccgctgacctgaaatctacgcagaatgccatagatgagatcacaaacaaggtcaatagtgtgatagaaaaaatgaatactcagttcacagctgttggaaaggagtttaaccacctcgagaagcgaattgagaacctgaacaagaaggtggacgatggctttttggatatctggacgtataacgctgagctgcttgttctgctggagaacgaaagaacccttgactaccacgattccaacgtgaagaatctgtatgagaaagtgcgaagccagttgaaaaacaacgcaaaagaaataggcaacggctgtttcgagttctaccacaaatgcgataacacctgcatggagagtgtgaag

SEQ ID NO: 44 - protein, 190 aa, Influenza A virus
LRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEID

SEQ ID NO: 45 - DNA, 507 bp, Influenza A virus
cttcacactctccatgcaggtgttatcgcatttgtggtagaactcgaaacagccgttgcctatttcttttgcgttgtttttcaactggcttcgcactttctcatacagattcttcacgttggaatcgtggtagtcaagggttctttcgttctccagcagaacaagcagctcagcgttatacgtccagatatccaaaaagccatcgtccaccttcttgttcaggttctcaattcgcttctcgaggtggttaaactcctttccaacagctgtgaactgagtattcattttttctatcacactattgaccttgtttgtgatctcatctatggcattctgcgtagatttcaggtcagcggcgtatccggagccctgctcattttgatgatggtagccgtaccaaccgtccaccatccccgtccagccgccttcaataaatccggcgatagcgccgaacagaccccgtgactggatgcttgggatattcctgagtccggtggcgagtctcag

SEQ ID NO: 46 - DNA, 471 bp, Influenza A virus
ctgagactcgccaccggactcaggaatatcccaagcatccagtcacggggtctgttcggcgctatcgccggatttattgaaggcggctggacggggatggtggacggttggtacggctaccatcatcaaaatgagcagggctccggatacgccgctgacctgaaatctacgcagaatgccatagatgagatcacaaacaaggtcaatagtgtgatagaaaaaatgacgtataacgctgagctgcttgttctgctggagaacgaaagaacccttgactaccacgattccaacgtgaagaatctgtatgagaaagtgcgaagccagttgaaaaacaacgcaaaagaaataggcaacggctgtttcgagttctaccacaaatgcgataacacctgcatggagagtgtgaagaacggaacgtacgattatccaaaatactccgaggaggccaaactcaatagggaggagatagac

SEQ ID NO: 47 - protein, 157 aa, Influenza A virus
LRLATGLRNIPSIQSRGLFGAIAGFIEGGWTGMVDGWYGYHHQNEQGSGYAADLKSTQNAIDEITNKVNSVIEKMTYNAELLVLLENERTLDYHDSNVKNLYEKVRSQLKNNAKEIGNGCFEFYHKCDNTCMESVKNGTYDYPKYSEEAKLNREEID

SEQ ID NO: 48 - DNA, 471 bp, Influenza A virus
gtctatctcctccctattgagtttggcctcctcggagtattttggataatcgtacgttccgttcttcacactctccatgcaggtgttatcgcatttgtggtagaactcgaaacagccgttgcctatttcttttgcgttgtttttcaactggcttcgcactttctcatacagattcttcacgttggaatcgtggtagtcaagggttctttcgttctccagcagaacaagcagctcagcgttatacgtcattttttctatcacactattgaccttgtttgtgatctcatctatggcattctgcgtagatttcaggtcagcggcgtatccggagccctgctcattttgatgatggtagccgtaccaaccgtccaccatccccgtccagccgccttcaataaatccggcgatagcgccgaacagaccccgtgactggatgcttgggatattcctgagtccggtggcgagtctcag

SEQ ID NO: 49 - DNA, 141 bp, Influenza A virus
atggccatcatctacctgatcctgctgtttacagctgtgagaggcgaccagatctgtatcggctaccacgccaacaatagcaccgagaaggtggacaccatcctggagagaaacgtgacagtgacccacgccaaggacatc

SEQ ID NO: 50 - protein, 47 aa, Influenza A virus
MAIIYLILLFTAVRGDQICIGYHANNSTEKVDTILERNVTVTHAKDI

SEQ ID NO: 51 - DNA, 141 bp, Influenza A virus
gatgtccttggcgtgggtcactgtcacgtttctctccaggatggtgtccaccttctcggtgctattgttggcgtggtagccgatacagatctggtcgcctctcacagctgtaaacagcaggatcaggtagatgatggccat

SEQ ID NO: 52 - DNA, 672 bp, Influenza A virus
aagtgccagacacctctgggcgccatcaataccaccctgcccttccacaatgtgcaccctctgaccatcggcgagtgccctaagtatgtgaagagcgagaagctggtgctggccacaggactgagaaacgtgccccagatcgagagcagaggcctgtttggagccatcgccggattcatcgagggaggatggcagggaatggtcgatggctggtacggctaccaccacagcaatgatcagggctctggctatgccgccgataaggagtctacccagaaggcctttgacggcatcaccaacaaggtgaacagcgtgatcgagaagatgaacacccagtttgaggctgtgggcaaggagtttagcaacctggagcggagactggagaacctgaacaagaagatggaggacggcttcctggatgtgtggacctacaatgccgaactgctggtgctgatggagaatgagcggaccctggacttccacgacagcaacgtgaagaacctgtacgacaaagtgaggatgcagctgagggacaacgtgaaggaactgggcaatggctgcttcgagttctaccacaagtgtgacgacgagtgtatgaactccgtgaagaacggcacctacgactaccctaagtacgaggaggagagcaagctgaaccggaacgagatcaag

SEQ ID NO: 53 - protein, 224 aa, Influenza A virus
KCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIK

SEQ ID NO: 54 - DNA, 672 bp, Influenza A virus
cttgatctcgttccggttcagcttgctctcctcctcgtacttagggtagtcgtaggtgccgttcttcacggagttcatacactcgtcgtcacacttgtggtagaactcgaagcagccattgcccagttccttcacgttgtccctcagctgcatcctcactttgtcgtacaggttcttcacgttgctgtcgtggaagtccagggtccgctcattctccatcagcaccagcagttcggcattgtaggtccacacatccaggaagccgtcctccatcttcttgttcaggttctccagtctccgctccaggttgctaaactccttgcccacagcctcaaactgggtgttcatcttctcgatcacgctgttcaccttgttggtgatgccgtcaaaggccttctgggtagactccttatcggcggcatagccagagccctgatcattgctgtggtggtagccgtaccagccatcgaccattccctgccatcctccctcgatgaatccggcgatggctccaaacaggcctctgctctcgatctggggcacgtttctcagtcctgtggccagcaccagcttctcgctcttcacatacttagggcactcgccgatggtcagagggtgcacattgtggaagggcagggtggtattgatggcgcccagaggtgtctggcactt

SEQ ID NO: 55 - DNA, 573 bp, Influenza A virus
aagtgccagacacctctgggcgccatcaataccaccctgcccttccacaatgtgcaccctctgaccatcggcgagtgccctaagtatgtgaagagcgagaagctggtgctggccacaggactgagaaacgtgccccagatcgagagcagaggcctgtttggagccatcgccggattcatcgagggaggatggcagggaatggtcgatggctggtacggctaccaccacagcaatgatcagggctctggctatgccgccgataaggagtctacccagaaggcctttgacggcatcaccaacaaggtgaacagcgtgatcgagaagatgacctacaatgccgaactgctggtgctgatggagaatgagcggaccctggacttccacgacagcaacgtgaagaacctgtacgacaaagtgaggatgcagctgagggacaacgtgaaggaactgggcaatggctgcttcgagttctaccacaagtgtgacgacgagtgtatgaactccgtgaagaacggcacctacgactaccctaagtacgaggaggagagcaagctgaaccggaacgagatcaag

SEQ ID NO: 56 - protein, 191 aa, Influenza A virus
KCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMTYNAELLVLMENERTLDFHDSNVKNLYDKVRMQLRDNVKELGNGCFEFYHKCDDECMNSVKNGTYDYPKYEEESKLNRNEIK

SEQ ID NO: 57 - DNA, 573 bp, Influenza A virus
cttgatctcgttccggttcagcttgctctcctcctcgtacttagggtagtcgtaggtgccgttcttcacggagttcatacactcgtcgtcacacttgtggtagaactcgaagcagccattgcccagttccttcacgttgtccctcagctgcatcctcactttgtcgtacaggttcttcacgttgctgtcgtggaagtccagggtccgctcattctccatcagcaccagcagttcggcattgtaggtcatcttctcgatcacgctgttcaccttgttggtgatgccgtcaaaggccttctgggtagactccttatcggcggcatagccagagccctgatcattgctgtggtggtagccgtaccagccatcgaccattccctgccatcctccctcgatgaatccggcgatggctccaaacaggcctctgctctcgatctggggcacgtttctcagtcctgtggccagcaccagcttctcgctcttcacatacttagggcactcgccgatggtcagagggtgcacattgtggaagggcagggtggtattgatggcgcccagaggtgtctggcactt

SEQ ID NO: 58 - DNA, 570 bp, Influenza A virus
ctggtgctggccacaggactgagaaacgtgccccagatcgagagcagaggcctgtttggagccatcgccggattcatcgagggaggatggcagggaatggtcgatggctggtacggctaccaccacagcaatgatcagggctctggctatgccgccgataaggagtctacccagaaggcctttgacggcatcaccaacaaggtgaacagcgtgatcgagaagatgaacacccagtttgaggctgtgggcaaggagtttagcaacctggagcggagactggagaacctgaacaagaagatggaggacggcttcctggatgtgtggacctacaatgccgaactgctggtgctgatggagaatgagcggaccctggacttccacgacagcaacgtgaagaacctgtacgacaaagtgaggatgcagctgagggacaacgtgaaggaactgggcaatggctgcttcgagttctaccacaagtgtgacgacgagtgtatgaactccgtgaagaacggcacctacgactaccctaagtacgaggaggagagcaagctgaaccggaacgagatcaag

SEQ ID NO: 59 - protein, 190 aa, Influenza A virus
LVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIK

SEQ ID NO: 60 - DNA, 570 bp, Influenza A virus
cttgatctcgttccggttcagcttgctctcctcctcgtacttagggtagtcgtaggtgccgttcttcacggagttcatacactcgtcgtcacacttgtggtagaactcgaagcagccattgcccagttccttcacgttgtccctcagctgcatcctcactttgtcgtacaggttcttcacgttgctgtcgtggaagtccagggtccgctcattctccatcagcaccagcagttcggcattgtaggtccacacatccaggaagccgtcctccatcttcttgttcaggttctccagtctccgctccaggttgctaaactccttgcccacagcctcaaactgggtgttcatcttctcgatcacgctgttcaccttgttggtgatgccgtcaaaggccttctgggtagactccttatcggcggcatagccagagccctgatcattgctgtggtggtagccgtaccagccatcgaccattccctgccatcctccctcgatgaatccggcgatggctccaaacaggcctctgctctcgatctggggcacgtttctcagtcctgtggccagcaccag

SEQ ID NO: 61 - DNA, 471 bp, Influenza A virus
ctggtgctggccacaggactgagaaacgtgccccagatcgagagcagaggcctgtttggagccatcgccggattcatcgagggaggatggcagggaatggtcgatggctggtacggctaccaccacagcaatgatcagggctctggctatgccgccgataaggagtctacccagaaggcctttgacggcatcaccaacaaggtgaacagcgtgatcgagaagatgacctacaatgccgaactgctggtgctgatggagaatgagcggaccctggacttccacgacagcaacgtgaagaacctgtacgacaaagtgaggatgcagctgagggacaacgtgaaggaactgggcaatggctgcttcgagttctaccacaagtgtgacgacgagtgtatgaactccgtgaagaacggcacctacgactaccctaagtacgaggaggagagcaagctgaaccggaacgagatcaag

SEQ ID NO: 62 - protein, 157 aa, Influenza A virus
LVLATGLRNVPQIESRGLFGAIAGFIEGGWQGMVDGWYGYHHSNDQGSGYAADKESTQKAFDGITNKVNSVIEKMTYNAELLVLMENERTLDFHDSNVKNLYDKVRMQLRDNVKELGNGCFEFYHKCDDECMNSVKNGTYDYPKYEEESKLNRNEIK

SEQ ID NO: 63 - DNA, 471 bp, Influenza A virus
cttgatctcgttccggttcagcttgctctcctcctcgtacttagggtagtcgtaggtgccgttcttcacggagttcatacactcgtcgtcacacttgtggtagaactcgaagcagccattgcccagttccttcacgttgtccctcagctgcatcctcactttgtcgtacaggttcttcacgttgctgtcgtggaagtccagggtccgctcattctccatcagcaccagcagttcggcattgtaggtcatcttctcgatcacgctgttcaccttgttggtgatgccgtcaaaggccttctgggtagactccttatcggcggcatagccagagccctgatcattgctgtggtggtagccgtaccagccatcgaccattccctgccatcctccctcgatgaatccggcgatggctccaaacaggcctctgctctcgatctggggcacgtttctcagtcctgtggccagcaccag

SEQ ID NO: 64 - DNA, 150 bp, Influenza A virus
gccaccatggaaaagatcgtgctgctgctggccattgtgagcctggtgaagagcgaccagatctgcattggctaccacgccaacaatagcacagagcaggtggacaccatcatggaaaaaaacgtgaccgtgacccacgctcaggacatc

SEQ ID NO: 65 - protein, 48 aa, Influenza A virus
MEKIVLLLAIVSLVKSDQICIGYHANNSTEQVDTIMEKNVTVTHAQDI

SEQ ID NO: 66 - DNA, 150 bp, Influenza A virus
gatgtcctgagcgtgggtcacggtcacgtttttttccatgatggtgtccacctgctctgtgctattgttggcgtggtagccaatgcagatctggtcgctcttcaccaggctcacaatggccagcagcagcacgatcttttccatggtggc

SEQ ID NO: 67 - DNA, 681 bp, Influenza A virus
aagtgccagacacctatgggcgccatcaacagcagcatgcccttccacaacatccaccctctgaccatcggcgagtgccctaagtacgtgaagagcaacagactggtgctggccacaggcctgagaaatagcccccagcgggagagcagaagaaagaagaggggcctgtttggagccatcgccggctttattgaaggcggctggcagggaatggtggatggctggtacggctaccaccacagcaatgagcagggctctggatatgccgccgacaaagagtctacccagaaggccatcgacggcgtcaccaacaaggtgaacagcatcatcgacaagatgaacacccagttcgaggctgtgggcagagagttcaacaacctggaacggcggatcgagaacctgaacaagaaaatggaagatggcttcctggatgtgtggacctacaatgccgaactgctggtgctgatggaaaacgagcggaccctggacttccacgacagcaacgtgaagaacctgtacgacaaagtgcggctgcagctgagagacaacgccaaagagctgggcaacggctgcttcgagttctaccacaagtgcgacaacgagtgcatggaaagcatccggaacggcacctacaactaccctcagtacagcgaggaagccaggctgaagagggaagagatc

SEQ ID NO: 68 - protein, 227 aa, Influenza A virus
KCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEI

SEQ ID NO: 69 - DNA, 681 bp, Influenza A virus
gatctcttccctcttcagcctggcttcctcgctgtactgagggtagttgtaggtgccgttccggatgctttccatgcactcgttgtcgcacttgtggtagaactcgaagcagccgttgcccagctctttggcgttgtctctcagctgcagccgcactttgtcgtacaggttcttcacgttgctgtcgtggaagtccagggtccgctcgttttccatcagcaccagcagttcggcattgtaggtccacacatccaggaagccatcttccattttcttgttcaggttctcgatccgccgttccaggttgttgaactctctgcccacagcctcgaactgggtgttcatcttgtcgatgatgctgttcaccttgttggtgacgccgtcgatggccttctgggtagactctttgtcggcggcatatccagagccctgctcattgctgtggtggtagccgtaccagccatccaccattccctgccagccgccttcaataaagccggcgatggctccaaacaggcccctcttctttcttctgctctcccgctgggggctatttctcaggcctgtggccagcaccagtctgttgctcttcacgtacttagggcactcgccgatggtcagagggtggatgttgtggaagggcatgctgctgttgatggcgcccataggtgtctggcactt

SEQ ID NO: 70 - DNA, 582 bp, Influenza A virus
aagtgccagacacctatgggcgccatcaacagcagcatgcccttccacaacatccaccctctgaccatcggcgagtgccctaagtacgtgaagagcaacagactggtgctggccacaggcctgagaaatagcccccagcgggagagcagaagaaagaagaggggcctgtttggagccatcgccggctttattgaaggcggctggcagggaatggtggatggctggtacggctaccaccacagcaatgagcagggctctggatatgccgccgacaaagagtctacccagaaggccatcgacggcgtcaccaacaaggtgaacagcatcatcgacaagatgacctacaatgccgaactgctggtgctgatggaaaacgagcggaccctggacttccacgacagcaacgtgaagaacctgtacgacaaagtgcggctgcagctgagagacaacgccaaagagctgggcaacggctgcttcgagttctaccacaagtgcgacaacgagtgcatggaaagcatccggaacggcacctacaactaccctcagtacagcgaggaagccaggctgaagagggaagagatc

SEQ ID NO: 71 - protein, 194 aa, Influenza A virus
KCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMTYNAELLVLMENERTLDFHDSNVKNLYDKVRLQLRDNAKELGNGCFEFYHKCDNECMESIRNGTYNYPQYSEEARLKREEI

SEQ ID NO: 72 - DNA, 582 bp, Influenza A virus
gatctcttccctcttcagcctggcttcctcgctgtactgagggtagttgtaggtgccgttccggatgctttccatgcactcgttgtcgcacttgtggtagaactcgaagcagccgttgcccagctctttggcgttgtctctcagctgcagccgcactttgtcgtacaggttcttcacgttgctgtcgtggaagtccagggtccgctcgttttccatcagcaccagcagttcggcattgtaggtcatcttgtcgatgatgctgttcaccttgttggtgacgccgtcgatggccttctgggtagactctttgtcggcggcatatccagagccctgctcattgctgtggtggtagccgtaccagccatccaccattccctgccagccgccttcaataaagccggcgatggctccaaacaggcccctcttctttcttctgctctcccgctgggggctatttctcaggcctgtggccagcaccagtctgttgctcttcacgtacttagggcactcgccgatggtcagagggtggatgttgtggaagggcatgctgctgttgatggcgcccataggtgtctggcactt

SEQ ID NO: 73 - DNA, 579 bp, Influenza A virus
ctggtgctggccacaggcctgagaaatagcccccagcgggagagcagaagaaagaagaggggcctgtttggagccatcgccggctttattgaaggcggctggcagggaatggtggatggctggtacggctaccaccacagcaatgagcagggctctggatatgccgccgacaaagagtctacccagaaggccatcgacggcgtcaccaacaaggtgaacagcatcatcgacaagatgaacacccagttcgaggctgtgggcagagagttcaacaacctggaacggcggatcgagaacctgaacaagaaaatggaagatggcttcctggatgtgtggacctacaatgccgaactgctggtgctgatggaaaacgagcggaccctggacttccacgacagcaacgtgaagaacctgtacgacaaagtgcggctgcagctgagagacaacgccaaagagctgggcaacggctgcttcgagttctaccacaagtgcgacaacgagtgcatggaaagcatccggaacggcacctacaactaccctcagtacagcgaggaagccaggctgaagagggaagagatc

SEQ ID NO: 74 - protein, 193 aa, Influenza A virus
LVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEI

SEQ ID NO: 75 - DNA, 579 bp, Influenza A virus
gatctcttccctcttcagcctggcttcctcgctgtactgagggtagttgtaggtgccgttccggatgctttccatgcactcgttgtcgcacttgtggtagaactcgaagcagccgttgcccagctctttggcgttgtctctcagctgcagccgcactttgtcgtacaggttcttcacgttgctgtcgtggaagtccagggtccgctcgttttccatcagcaccagcagttcggcattgtaggtccacacatccaggaagccatcttccattttcttgttcaggttctcgatccgccgttccaggttgttgaactctctgcccacagcctcgaactgggtgttcatcttgtcgatgatgctgttcaccttgttggtgacgccgtcgatggccttctgggtagactctttgtcggcggcatatccagagccctgctcattgctgtggtggtagccgtaccagccatccaccattccctgccagccgccttcaataaagccggcgatggctccaaacaggcccctcttctttcttctgctctcccgctgggggctatttctcaggcctgtggccagcaccag

SEQ ID NO: 76 - DNA, 480 bp, Influenza A virus
ctggtgctggccacaggcctgagaaatagcccccagcgggagagcagaagaaagaagaggggcctgtttggagccatcgccggctttattgaaggcggctggcagggaatggtggatggctggtacggctaccaccacagcaatgagcagggctctggatatgccgccgacaaagagtctacccagaaggccatcgacggcgtcaccaacaaggtgaacagcatcatcgacaagatgacctacaatgccgaactgctggtgctgatggaaaacgagcggaccctggacttccacgacagcaacgtgaagaacctgtacgacaaagtgcggctgcagctgagagacaacgccaaagagctgggcaacggctgcttcgagttctaccacaagtgcgacaacgagtgcatggaaagcatccggaacggcacctacaactaccctcagtacagcgaggaagccaggctgaagagggaagagatc

SEQ ID NO: 77 - protein, 160 aa, Influenza A virus
LVLATGLRNSPQRESRRKKRGLFGAIAGFIEGGWQGMVDGWYGYHHSNEQGSGYAADKESTQKAIDGVTNKVNSIIDKMTYNAELLVLMENERTLDFHDSNVKNLYDKVRLQLRDNAKELGNGCFEFYHKCDNECMESIRNGTYNYPQYSEEARLKREEI

SEQ ID NO: 78 - DNA, 480 bp, Influenza A virus
gatctcttccctcttcagcctggcttcctcgctgtactgagggtagttgtaggtgccgttccggatgctttccatgcactcgttgtcgcacttgtggtagaactcgaagcagccgttgcccagctctttggcgttgtctctcagctgcagccgcactttgtcgtacaggttcttcacgttgctgtcgtggaagtccagggtccgctcgttttccatcagcaccagcagttcggcattgtaggtcatcttgtcgatgatgctgttcaccttgttggtgacgccgtcgatggccttctgggtagactctttgtcggcggcatatccagagccctgctcattgctgtggtggtagccgtaccagccatccaccattccctgccagccgccttcaataaagccggcgatggctccaaacaggcccctcttctttcttctgctctcccgctgggggctatttctcaggcctgtggccagcaccag

SEQ ID NO: 79 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 80 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNQWTLLFHDSNVKNLYEKVKSQLKNNAKEIGNGCFEFYHKCNNECMESVKNGTYDYPKYSEESKLNREKID

SEQ ID NO: 81 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 82 - DNA, 645 bp, Artificial Sequence
  Synthetic
atgaaggcaatcctggtcgtcctgctgtatactttcgctaccgctaacgctgacaccctgtgcatcggctatcacgctaacaactcaaccgacacagtggatactgtcctggagaagaacgtgactgtcacccactctgtgaatctgggcagtggactgaggctggcaactggactgcgaaacatcccacagcgggaaaccagaggactgttcggcgctatcgcagggtttattgagggcgggtggacaggaatggtggacgggtggtacggctaccaccatcagaacgagcagggatcaggctacgccgctgacctgaagagcacacagaatgcaatcgatgaaattactaacatggtgaattccgtcatcgagaaaatgggcagcggaggctccggaaccgacctggcagaactgctggtgctgctgctgaaccagtggacactgctgtaccacgatagtaacgtgaagaatctgtatgagaaagtccgatcacagctgaagaacaatgctaaagaaatcgggaatggatgcttcgagttttaccataagtgcgacaacacctgtatggagagcgtgaaaaatggcacatacgattatcccaagtattccgaggaagccaaactgaacagagaggaaattgac

SEQ ID NO: 83 - protein, 215 aa, Artificial Sequence
  Synthetic
MKAKLLVLLCTFTATYADTLCIGYHANNSTDTVDTVLEKNVTVTHSVNLGSGLRLATGLRNIPQRETRGLFGAIAGFIEGGWTGMVDGWYGYHHQNEQGSGYAADLKSTQNAIDEITNMVNSVIEKMGSGGSGTDLAELLVLLLNQWTLLYHDSNVKNLYEKVRSQLKNNAKEIGNGCFEFYHKCDNTCMESVKNGTYDYPKYSEEAKLNREEID

SEQ ID NO: 84 - DNA, 645 bp, Artificial Sequence
  Synthetic
gtcaatttcctctctgttcagtttggcttcctcggaatacttgggataatcgtatgtgccatttttcacgctctccatacaggtgttgtcgcacttatggtaaaactcgaagcatccattcccgatttctttagcattgttcttcagctgtgatcggactttctcatacagattcttcacgttactatcgtggtacagcagtgtccactggttcagcagcagcaccagcagttctgccaggtcggttccggagcctccgctgcccattttctcgatgacggaattcaccatgttagtaatttcatcgattgcattctgtgtgctcttcaggtcagcggcgtagcctgatccctgctcgttctgatggtggtagccgtaccacccgtccaccattcctgtccacccgccctcaataaaccctgcgatagcgccgaacagtcctctggtttcccgctgtgggatgtttcgcagtccagttgccagcctcagtccactgcccagattcacagagtgggtgacagtcacgttcttctccaggacagtatccactgtgtcggttgagttgttagcgtgatagccgatgcacagggtgtcagcgttagcggtagcgaaagtatacagcaggacgaccaggattgccttcat

SEQ ID NO: 85 - DNA, 639 bp, Artificial Sequence
  Synthetic
atggctatcatctacctgatcctgctgttcactgctgtgcggggggaccagatttgcatcggctaccacgctaataattcaactgagaaggtggatactatcctggagcggaacgtgaccgtcacacacgctaaagacattggcagcggactggtgctggcaaccggactgaggaatgtcccacagatcgagtcccgcggactgttcggcgctatcgcagggtttattgaaggcgggtggcagggaatgattgatgggtggtacggctaccaccattctaacgaccaaggaagtggctacgccgctgataaggagagtactcagaaagccttcgatggcatcaccaacatggtgaattcagtcattgagaagatgggcagcggaggctccggaaccgacctggcagaactgctggtgctgctgctgaatcagtggacactgctgtttcacgactctaacgtgaagaatctgtatgataaagtccggatgcagctgagagacaacgtgaaggagctggggaatggatgcttcgaattttaccataagtgcgacgatgagtgtatgaacagtgtcaaaaatggcacatacgattatcccaagtatgaggaagagtcaaaactgaaccgaaatgaaatcaag

SEQ ID NO: 86 - protein, 213 aa, Artificial Sequence
  Synthetic
MAIIYLILLFTAVRGDQICIGYHANNSTEKVDTILERNVTVTHAKDIGSGLVLATGLRNVPQIESRGLFGAIAGFIEGGWQGMIDGWYGYHHSNDQGSGYAADKESTQKAFDGITNMVNSVIEKMGSGGSGTDLAELLVLLLNQWTLLFHDSNVKNLYDKVRMQLRDNVKELGNGCFEFYHKCDDECMNSVKNGTYDYPKYEEESKLNRNEIK

SEQ ID NO: 87 - DNA, 639 bp, Artificial Sequence
  Synthetic
cttgatttcatttcggttcagttttgactcttcctcatacttgggataatcgtatgtgccatttttgacactgttcatacactcatcgtcgcacttatggtaaaattcgaagcatccattccccagctccttcacgttgtctctcagctgcatccggactttatcatacagattcttcacgttagagtcgtgaaacagcagtgtccactgattcagcagcagcaccagcagttctgccaggtcggttccggagcctccgctgcccatcttctcaatgactgaattcaccatgttggtgatgccatcgaaggctttctgagtactctccttatcagcggcgtagccacttccttggtcgttagaatggtggtagccgtaccacccatcaatcattccctgccacccgccttcaataaaccctgcgatagcgccgaacagtccgcgggactcgatctgtgggacattcctcagtccggttgccagcaccagtccgctgccaatgtctttagcgtgtgtgacggtcacgttccgctccaggatagtatccaccttctcagttgaattattagcgtggtagccgatgcaaatctggtccccccgcacagcagtgaacagcaggatcaggtagatgatagccat

SEQ ID NO: 88 - DNA, 651 bp, Artificial Sequence
  Synthetic
atggaaaaaatcgtgctgctgctggctatcgtgtccctggtgaagtccgaccagatctgtattgggtatcatgctaacaactccacagaacaggtggatactatcatggagaagaacgtgaccgtcacacacgctcaggacattggatggggactggtcctggcaaccggactgagaaattcaccacagagggaaagccggagaaagaaacgcggactgttcggcgctatcgcagggtttattgagggcgggtggcagggaatggtggatgggtggtacggctaccaccattccaacgaacagggatctggctacgccgctgataaggagtctactcagaaagctatcgacggcgtgaccaacatggtcaatagtatcattgataagatgggctctggaggcagtggaaccgacctggcagagctgctggtgctgctgctgaaccagtggacactgctgttccacgactctaacgtgaagaatctgtatgataaagtccgactgcagctgcgggacaacgccaaggaactggggaatggatgcttcgagttctaccataagtgcgataacgaatgtatggagagcatccgaaacggcacatacaattatccccagtattccgaggaagctaggctgaaacgcgaggaaatt

SEQ ID NO: 89 - protein, 217 aa, Artificial Sequence
  Synthetic
MEKIVLLLAIVSLVKSDQICIGYHANNSTEQVDTIMEKNVTVTHAQDIGWGLVLATGLRNSPQRESRRKKRGLFGAIAGFIEGGWQGMVDGWYGYHHSNEQGSGYAADKESTQKAIDGVTNMVNSIIDKMGSGGSGTDLAELLVLLLNQWTLLFHDSNVKNLYDKVRLQLRDNAKELGNGCFEFYHKCDNECMESIRNGTYNYPQYSEEARLKREEI

SEQ ID NO: 90 - DNA, 651 bp, Artificial Sequence
  Synthetic
aatttcctcgcgtttcagcctagcttcctcggaatactggggataattgtatgtgccgtttcggatgctctccatacattcgttatcgcacttatggtagaactcgaagcatccattccccagttccttggcgttgtcccgcagctgcagtcggactttatcatacagattcttcacgttagagtcgtggaacagcagtgtccactggttcagcagcagcaccagcagctctgccaggtcggttccactgcctccagagcccatcttatcaatgatactattgaccatgttggtcacgccgtcgatagctttctgagtagactccttatcagcggcgtagccagatccctgttcgttggaatggtggtagccgtaccacccatccaccattccctgccacccgccctcaataaaccctgcgatagcgccgaacagtccgcgtttctttctccggctttccctctgtggtgaatttctcagtccggttgccaggaccagtccccatccaatgtcctgagcgtgtgtgacggtcacgttcttctccatgatagtatccacctgttctgtggagttgttagcatgatacccaatacagatctggtcggacttcaccagggacacgatagccagcagcagcacgattttttccat

SEQ ID NO: 91 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 92 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKID

SEQ ID NO: 93 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 94 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccattctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgatgctgaaccagttcactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 95 - protein, 215 aa, Artificial Sequence
  Synthetic
MKAKLLVLLCTFTATYADTICIGYHANNSTDTVDTILEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLMLNQFTLLFHDSNVKNLYEKVKSQLKNNAKEIGNGCFEFYHKCNNECMESVKNGTYDYPKYSEESKLNREKID

SEQ ID NO: 96 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtgaactggttcagcatcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccagaatggtatccactgtgtcggtggagttgtttgcgtgatagccgatgcagatagtgtcagcgtaggttgcggtaaaagtacacagcaggaccagcagtttggccttcat

SEQ ID NO: 97 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcaatggaacaggcggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 98 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGNGTGGADLAELLVLLLNQWTLLFHDSNVKNLYEKVKSQLKNNAKEIGNGCFEFYHKCNNECMESVKNGTYDYPKYSEESKLNREKID

SEQ ID NO: 99 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccgcctgttccattgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 100 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 101 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKID

SEQ ID NO: 102 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccagtgccatttccgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 103 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggcaacggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 104 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGNGTDLAELLVLLLNQWTLLFHDSNVKNLYEKVKSQLKNNAKEIGNGCFEFYHKCNNECMESVKNGTYDYPKYSEESKLNREKID

SEQ ID NO: 105 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccgttgcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 106 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 107 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 108 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 109 - DNA, 1149 bp, Artificial Sequence
  Synthetic
atgaaggcaatcctggtcgtcctgctgtatactttcgctaccgctaacgctgacaccctgtgcatcggctatcacgctaacaactcaaccgacacagtggatactgtcctggagaagaacgtgactgtcacccactctgtgaatctgggcagtggactgaggctggcaactggactgcgaaacatcccacagcgggaaaccagaggactgttcggcgctatcgcagggtttattgagggcgggtggacaggaatggtggacgggtggtacggctaccaccatcagaacgagcagggatcaggctacgccgctgacctgaagagcacacagaatgcaatcgatgaaattactaacatggtgaattccgtcatcgagaaaatgggcagcggaggctccggaaccgacctggcagaactgctggtgctgctgctgaaccagtggacactgctgtaccacgatagtaacgtgaagaatctgtatgagaaagtccgatcacagctgaagaacaatgctaaagaaatcgggaatggatgcttcgagttttaccataagtgcgacaacacctgtatggagagcgtgaaaaatggcacatacgattatcccaagtattccgaggaagccaaactgaacagagaggaaattgactctgggggcgacatcatcaagctgctgaacgaacaggtcaacaaggagatgcagagctccaatctgtacatgtccatgtctagttggtgttatacccactctctggacggcgctgggctgttcctgtttgatcacgcagccgaggaatacgaacatgcaaagaaactgatcattttcctgaacgagaacaatgtgcccgtccagctgacatcaatcagcgcccctgaacataagttcgagggcctgactcagatctttcagaaagcttacgaacacgagcagcatatttccgaatctatcaacaatattgtggaccacgccattaagagtaaagatcatgctaccttcaattttctgcagtggtacgtggccgagcagcacgaggaggaggtcctgtttaaggacatcctggataaaatcgaactgattggaaacgagaatcatggcctgtacctggcagatcagtatgtgaagggcattgccaagagccggaaaagtgggtca

SEQ ID NO: 110 - protein, 383 aa, Artificial Sequence
  Synthetic
MKAKLLVLLCTFTATYADTLCIGYHANNSTDTVDTVLEKNVTVTHSVNLGSGLRLATGLRNIPQRETRGLFGAIAGFIEGGWTGMVDGWYGYHHQNEQGSGYAADLKSTQNAIDEITNMVNSVIEKMGSGGSGTDLAELLVLLLNQWTLLYHDSNVKNLYEKVRSQLKNNAKEIGNGCFEFYHKCDNTCMESVKNGTYDYPKYSEEAKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 111 - DNA, 1149 bp, Artificial Sequence
  Synthetic
tgacccacttttccggctcttggcaatgcccttcacatactgatctgccaggtacaggccatgattctcgtttccaatcagttcgattttatccaggatgtccttaaacaggacctcctcctcgtgctgctcggccacgtaccactgcagaaaattgaaggtagcatgatctttactcttaatggcgtggtccacaatattgttgatagattcggaaatatgctgctcgtgttcgtaagctttctgaaagatctgagtcaggccctcgaacttatgttcaggggcgctgattgatgtcagctggacgggcacattgttctcgttcaggaaaatgatcagtttctttgcatgttcgtattcctcggctgcgtgatcaaacaggaacagcccagcgccgtccagagagtgggtataacaccaactagacatggacatgtacagattggagctctgcatctccttgttgacctgttcgttcagcagcttgatgatgtcgcccccagagtcaatttcctctctgttcagtttggcttcctcggaatacttgggataatcgtatgtgccatttttcacgctctccatacaggtgttgtcgcacttatggtaaaactcgaagcatccattcccgatttctttagcattgttcttcagctgtgatcggactttctcatacagattcttcacgttactatcgtggtacagcagtgtccactggttcagcagcagcaccagcagttctgccaggtcggttccggagcctccgctgcccattttctcgatgacggaattcaccatgttagtaatttcatcgattgcattctgtgtgctcttcaggtcagcggcgtagcctgatccctgctcgttctgatggtggtagccgtaccacccgtccaccattcctgtccacccgccctcaataaaccctgcgatagcgccgaacagtcctctggtttcccgctgtgggatgtttcgcagtccagttgccagcctcagtccactgcccagattcacagagtgggtgacagtcacgttcttctccaggacagtatccactgtgtcggttgagttgttagcgtgatagccgatgcacagggtgtcagcgttagcggtagcgaaagtatacagcaggacgaccaggattgccttcat

SEQ ID NO: 112 - DNA, 1143 bp, Artificial Sequence
  Synthetic
atggctatcatctacctgatcctgctgttcactgctgtgcggggggaccagatttgcatcggctaccacgctaataattcaactgagaaggtggatactatcctggagcggaacgtgaccgtcacacacgctaaagacattggcagcggactggtgctggcaaccggactgaggaatgtcccacagatcgagtcccgcggactgttcggcgctatcgcagggtttattgaaggcgggtggcagggaatgattgatgggtggtacggctaccaccattctaacgaccaaggaagtggctacgccgctgataaggagagtactcagaaagccttcgatggcatcaccaacatggtgaattcagtcattgagaagatgggcagcggaggctccggaaccgacctggcagaactgctggtgctgctgctgaatcagtggacactgctgtttcacgactctaacgtgaagaatctgtatgataaagtccggatgcagctgagagacaacgtgaaggagctggggaatggatgcttcgaattttaccataagtgcgacgatgagtgtatgaacagtgtcaaaaatggcacatacgattatcccaagtatgaggaagagtcaaaactgaaccgaaatgaaatcaagagcgggggcgacatcatcaagctgctgaacgagcaagtgaataaggaaatgcagagctccaacctgtacatgtccatgtctagttggtgttatactcactctctggatggcgccgggctgttcctgtttgaccacgcagccgaagagtacgagcatgctaagaaactgatcattttcctgaacgaaaacaacgtgcccgtccagctgacatcaatcagcgcacctgagcataagttcgaaggcctgactcagatctttcagaaagcttacgagcacgaacagcatatttccgagtctatcaacaatattgtggaccacgccatcaagagcaaagatcatgctaccttcaactttctgcagtggtacgtggccgagcagcacgaagaggaagtcctgtttaaggacatcctggataaaatcgagctgattggaaacgaaaatcatggcctgtacctggcagaccagtatgtgaagggcattgccaagtccagaaaaagtgggtca

SEQ ID NO: 113 - protein, 381 aa, Artificial Sequence
  Synthetic
MAIIYLILLFTAVRGDQICIGYHANNSTEKVDTILERNVTVTHAKDIGSGLVLATGLRNVPQIESRGLFGAIAGFIEGGWQGMIDGWYGYHHSNDQGSGYAADKESTQKAFDGITNMVNSVIEKMGSGGSGTDLAELLVLLLNQWTLLFHDSNVKNLYDKVRMQLRDNVKELGNGCFEFYHKCDDECMNSVKNGTYDYPKYEEESKLNRNEIKSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 114 - DNA, 1143 bp, Artificial Sequence
  Synthetic
tgacccactttttctggacttggcaatgcccttcacatactggtctgccaggtacaggccatgattttcgtttccaatcagctcgattttatccaggatgtccttaaacaggacttcctcttcgtgctgctcggccacgtaccactgcagaaagttgaaggtagcatgatctttgctcttgatggcgtggtccacaatattgttgatagactcggaaatatgctgttcgtgctcgtaagctttctgaaagatctgagtcaggccttcgaacttatgctcaggtgcgctgattgatgtcagctggacgggcacgttgttttcgttcaggaaaatgatcagtttcttagcatgctcgtactcttcggctgcgtggtcaaacaggaacagcccggcgccatccagagagtgagtataacaccaactagacatggacatgtacaggttggagctctgcatttccttattcacttgctcgttcagcagcttgatgatgtcgcccccgctcttgatttcatttcggttcagttttgactcttcctcatacttgggataatcgtatgtgccatttttgacactgttcatacactcatcgtcgcacttatggtaaaattcgaagcatccattccccagctccttcacgttgtctctcagctgcatccggactttatcatacagattcttcacgttagagtcgtgaaacagcagtgtccactgattcagcagcagcaccagcagttctgccaggtcggttccggagcctccgctgcccatcttctcaatgactgaattcaccatgttggtgatgccatcgaaggctttctgagtactctccttatcagcggcgtagccacttccttggtcgttagaatggtggtagccgtaccacccatcaatcattccctgccacccgccttcaataaaccctgcgatagcgccgaacagtccgcgggactcgatctgtgggacattcctcagtccggttgccagcaccagtccgctgccaatgtctttagcgtgtgtgacggtcacgttccgctccaggatagtatccaccttctcagttgaattattagcgtggtagccgatgcaaatctggtccccccgcacagcagtgaacagcaggatcaggtagatgatagccat

SEQ ID NO: 115 - DNA, 1158 bp, Artificial Sequence
  Synthetic
atggaaaaaatcgtgctgctgctggctatcgtgtccctggtgaagtccgaccagatctgtattgggtatcatgctaacaactccacagaacaggtggatactatcatggagaagaacgtgaccgtcacacacgctcaggacattggatggggactggtcctggcaaccggactgagaaattcaccacagagggaaagccggagaaagaaacgcggactgttcggcgctatcgcagggtttattgagggcgggtggcagggaatggtggatgggtggtacggctaccaccattccaacgaacagggatctggctacgccgctgataaggagtctactcagaaagctatcgacggcgtgaccaacatggtcaatagtatcattgataagatgggctctggaggcagtggaaccgacctggcagagctgctggtgctgctgctgaaccagtggacactgctgttccacgactctaacgtgaagaatctgtatgataaagtccgactgcagctgcgggacaacgccaaggaactggggaatggatgcttcgagttctaccataagtgcgataacgaatgtatggagagcatccgaaacggcacatacaattatccccagtattccgaggaagctaggctgaaacgcgaggaaattagctccgggggagacatcattaagctgctgaacgaacaggtgaacaaggagatgcagtctagtaacctgtacatgagtatgtcaagctggtgttatactcactcactggatggcgccgggctgttcctgtttgaccacgcagccgaggaatacgaacatgctaagaaactgatcattttcctgaatgagaacaatgtgcccgtccagctgacatccatctctgcacctgaacataagttcgagggcctgactcagatctttcagaaagcctacgaacacgagcagcatattagtgagtcaatcaacaatattgtggaccacgccatcaagagcaaagatcatgctaccttcaattttctgcagtggtacgtggccgagcagcacgaggaagaggtcctgtttaaggacatcctggataaaatcgaactgattggaaacgagaatcatggcctgtacctggcagaccagtatgtgaagggcattgccaagtccaggaaaagcgggtcc

SEQ ID NO: 116 - protein, 386 aa, Artificial Sequence
  Synthetic
MEKIVLLLAIVSLVKSDQICIGYHANNSTEQVDTIMEKNVTVTHAQDIGWGLVLATGLRNSPQRESRRKKRGLFGAIAGFIEGGWQGMVDGWYGYHHSNEQGSGYAADKESTQKAIDGVTNMVNSIIDKMGSGGSGTDLAELLVLLLNQWTLLFHDSNVKNLYDKVRLQLRDNAKELGNGCFEFYHKCDNECMESIRNGTYNYPQYSEEARLKREEISSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 117 - DNA, 1158 bp, Artificial Sequence
  Synthetic
ggacccgcttttcctggacttggcaatgcccttcacatactggtctgccaggtacaggccatgattctcgtttccaatcagttcgattttatccaggatgtccttaaacaggacctcttcctcgtgctgctcggccacgtaccactgcagaaaattgaaggtagcatgatctttgctcttgatggcgtggtccacaatattgttgattgactcactaatatgctgctcgtgttcgtaggctttctgaaagatctgagtcaggccctcgaacttatgttcaggtgcagagatggatgtcagctggacgggcacattgttctcattcaggaaaatgatcagtttcttagcatgttcgtattcctcggctgcgtggtcaaacaggaacagcccggcgccatccagtgagtgagtataacaccagcttgacatactcatgtacaggttactagactgcatctccttgttcacctgttcgttcagcagcttaatgatgtctcccccggagctaatttcctcgcgtttcagcctagcttcctcggaatactggggataattgtatgtgccgtttcggatgctctccatacattcgttatcgcacttatggtagaactcgaagcatccattccccagttccttggcgttgtcccgcagctgcagtcggactttatcatacagattcttcacgttagagtcgtggaacagcagtgtccactggttcagcagcagcaccagcagctctgccaggtcggttccactgcctccagagcccatcttatcaatgatactattgaccatgttggtcacgccgtcgatagctttctgagtagactccttatcagcggcgtagccagatccctgttcgttggaatggtggtagccgtaccacccatccaccattccctgccacccgccctcaataaaccctgcgatagcgccgaacagtccgcgtttctttctccggctttccctctgtggtgaatttctcagtccggttgccaggaccagtccccatccaatgtcctgagcgtgtgtgacggtcacgttcttctccatgatagtatccacctgttctgtggagttgttagcatgatacccaatacagatctggtcggacttcaccagggacacgatagccagcagcagcacgattttttccat

SEQ ID NO: 118 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 119 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 120 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 121 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccattctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgatgctgaaccagttcactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 122 - protein, 383 aa, Artificial Sequence
  Synthetic
MKAKLLVLLCTFTATYADTICIGYHANNSTDTVDTILEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLMLNQFTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 123 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtgaactggttcagcatcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccagaatggtatccactgtgtcggtggagttgtttgcgtgatagccgatgcagatagtgtcagcgtaggttgcggtaaaagtacacagcaggaccagcagtttggccttcat

SEQ ID NO: 124 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcaatggaacaggcggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 125 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGNGTGGADLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 126 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccgcctgttccattgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 127 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 128 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 129 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccagtgccatttccgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 130 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggcaacggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 131 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGNGTDLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 132 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccgttgcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 133 - protein, 33 aa, Influenza A virus
NTQFTAVGKEFNKLERRMENLNKKVDDGFLDIW

SEQ ID NO: 134 - protein, 12 aa, Influenza A virus
NTQFTAVGKEFN

SEQ ID NO: 135 - protein, 12 aa, Influenza A virus
NKLERRMENLNK

SEQ ID NO: 136 - protein, 11 aa, Influenza A virus
KKVDDGFLDIW

SEQ ID NO: 137 - protein, 33 aa, Influenza A virus
NTQFTAVGKEFNHLEKRIENLNKKVDDGFLDIW

SEQ ID NO: 138 - protein, 11 aa, Influenza A virus
NTQFTAVGKEF

SEQ ID NO: 139 - protein, 11 aa, Influenza A virus
FNHLEKRIENL

SEQ ID NO: 140 - protein, 13 aa, Influenza A virus
LNKKVDDGFLDIW

SEQ ID NO: 141 - protein, 33 aa, Influenza A virus
NTQFEAVGKEFSNLERRLENLNKKMEDGFLDVW

SEQ ID NO: 142 - protein, 11 aa, Influenza A virus
NTQFEAVGKEF

SEQ ID NO: 143 - protein, 12 aa, Influenza A virus
FSNLERRLENLN

SEQ ID NO: 144 - protein, 12 aa, Influenza A virus
NKKMEDGFLDVW

SEQ ID NO: 145 - protein, 33 aa, Influenza A virus
NTQFEAVGREFNNLERRIENLNKKMEDGFLDVW

SEQ ID NO: 146 - protein, 11 aa, Influenza A virus
NTQFEAVGREF

SEQ ID NO: 147 - protein, 12 aa, Influenza A virus
FNNLERRIENLN

SEQ ID NO: 148 - protein, 12 aa, Influenza A virus
NKKMEDGFLDVW

SEQ ID NO: 149 - protein, 53 aa, Influenza A virus
KVNSVIEKMNTQFTAVGKEFNKLERRMENLNKKVDDGFLDIWTYNAELLVLLE

SEQ ID NO: 150 - protein, 20 aa, Influenza A virus
KVNSVIEKMTYNAELLVLLE

SEQ ID NO: 151 - protein, 53 aa, Influenza A virus
KVNSVIEKMNTQFTAVGKEFNHLEKRIENLNKKVDDGFLDIWTYNAELLVLLE

SEQ ID NO: 152 - protein, 20 aa, Influenza A virus
KVNSVIEKMTYNAELLVLLE

SEQ ID NO: 153 - protein, 53 aa, Influenza A virus
KVNSVIEKMNTQFEAVGKEFSNLERRLENLNKKMEDGFLDVWTYNAELLVLME

SEQ ID NO: 154 - protein, 20 aa, Influenza A virus
KVNSVIEKMTYNAELLVLME

SEQ ID NO: 155 - protein, 53 aa, Influenza A virus
KVNSIIDKMNTQFEAVGREFNNLERRIENLNKKMEDGFLDVWTYNAELLVLME

SEQ ID NO: 156 - protein, 20 aa, Influenza A virus
KVNSIIDKMTYNAELLVLME

SEQ ID NO: 157 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgatgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 158 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLMNERTLDFHDSNVKNLYEKVKSQLKNNAKEIGNGCFEFYHKCNNECMESVKNGTYDYPKYSEESKLNREKID

SEQ ID NO: 159 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcatcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 160 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgatgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 161 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLMNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 162 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcatcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 163 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatcgtgaattctgtcatcgaaaaaatgggcagcggaggctccggaacagacctggctgagctgctggtgctgctgatcaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 164 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNIVNSVIEKMGSGGSGTDLAELLVLLINERTLDFHDSNVKNLYEKVKSQLKNNAKEIGNGCFEFYHKCNNECMESVKNGTYDYPKYSEESKLNREKID

SEQ ID NO: 165 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttgatcagcagcaccagcagctcagccaggtctgttccggagcctccgctgcccattttttcgatgacagaattcacgatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 166 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatcgtgaattctgtcatcgaaaaaatgggcagcggaggctccggaacagacctggctgagctgctggtgctgctgatcaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 167 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNIVNSVIEKMGSGGSGTDLAELLVLLINERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 168 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttgatcagcagcaccagcagctcagccaggtctgttccggagcctccgctgcccattttttcgatgacagaattcacgatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 169 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacctggtgaattctgtcatcgaaaaaatgggcagcggaggctccggaacagacctggctgagctgctggtgctgctgatcaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 170 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNLVNSVIEKMGSGGSGTDLAELLVLLINERTLDFHDSNVKNLYEKVKSQLKNNAKEIGNGCFEFYHKCNNECMESVKNGTYDYPKYSEESKLNREKID

SEQ ID NO: 171 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttgatcagcagcaccagcagctcagccaggtctgttccggagcctccgctgcccattttttcgatgacagaattcaccaggttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 172 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacctggtgaattctgtcatcgaaaaaatgggcagcggaggctccggaacagacctggctgagctgctggtgctgctgatcaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 173 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNLVNSVIEKMGSGGSGTDLAELLVLLINERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 174 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttgatcagcagcaccagcagctcagccaggtctgttccggagcctccgctgcccattttttcgatgacagaattcaccaggttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 175 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacctggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 176 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNLVNSVIEKMGSGGSGTDLAELLVLLLNERTLDFHDSNVKNLYEKVKSQLKNNAKEIGNGCFEFYHKCNNECMESVKNGTYDYPKYSEESKLNREKID

SEQ ID NO: 177 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagccaggtctgttccggagcctccgctgcccattttttcgatgacagaattcaccaggttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 178 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacctggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 179 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNLVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 180 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagccaggtctgttccggagcctccgctgcccattttttcgatgacagaattcaccaggttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 181 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccataacaatacccagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 182 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHNNTQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKID

SEQ ID NO: 183 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccagtgccatttccgcccattttttcgatgacagaattcaccatgttagtaatgccattgattgcgttctgtgtagacttctgatcagcggcgtagccgctgccctgggtattgttatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 184 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccataacaatacccagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgaacagcaccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 185 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHNNTQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMNSTNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 186 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggtgctgttcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccagtgccatttccgcccattttttcgatgacagaattcaccatgttagtaatgccattgattgcgttctgtgtagacttctgatcagcggcgtagccgctgccctgggtattgttatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 187 - DNA, 645 bp, Artificial Sequence; identical to SEQ ID NO: 181
  Synthetic

SEQ ID NO: 188 - protein, 215 aa, Artificial Sequence; identical to SEQ ID NO: 182
  Synthetic

SEQ ID NO: 189 - DNA, 645 bp, Artificial Sequence; identical to SEQ ID NO: 183
  Synthetic

SEQ ID NO: 190 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccataacaatacccagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgaacagcaccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtcaacctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 191 - protein, 383 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHNNTQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMNSTNLYMSMSSWCYTHSLDGAGLFLFDHAAEEYEHAKKLIIFLNENNVPVNLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 192 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcaggttgacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggtgctgttcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccagtgccatttccgcccattttttcgatgacagaattcaccatgttagtaatgccattgattgcgttctgtgtagacttctgatcagcggcgtagccgctgccctgggtattgttatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 193 - DNA, 465 bp, Aquifex aeolicus
atgcaaatttacgaagggaaactaaccgctgaagggctgaggttcggtatagtggcttccaggttcaaccacgcactcgtggatagactagttgagggagctatagactgcatagtaagacacgggggaagggaagaagacataacgctcgttagagtgccgggctcctgggaaattcccgtggctgcgggagagcttgcgagaaaagaggacatagacgctgtgatagcgataggagttctaataaggggggctactccccactttgattacatagcctctgaagtgtcaaaagggcttgcgaacctttccttagaactgagaaaacccataaccttcggtgttataactgcggacaccttggagcaggcgatagaaagggcgggaacaaagcacgggaataagggctgggaagctgcactttccgcaatagaaatggcaaacttatttaagagtctgagatga

SEQ ID NO: 194 - protein, 154 aa, Aquifex aeolicus
MQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 195 - DNA, 465 bp, Aquifex aeolicus
tcatctcagactcttaaataagtttgccatttctattgcggaaagtgcagcttcccagcccttattcccgtgctttgttcccgccctttctatcgcctgctccaaggtgtccgcagttataacaccgaaggttatgggttttctcagttctaaggaaaggttcgcaagcccttttgacacttcagaggctatgtaatcaaagtggggagtagccccccttattagaactcctatcgctatcacagcgtctatgtcctcttttctcgcaagctctcccgcagccacgggaatttcccaggagcccggcactctaacgagcgttatgtcttcttcccttcccccgtgtcttactatgcagtctatagctccctcaactagtctatccacgagtgcgtggttgaacctggaagccactataccgaacctcagcccttcagcggttagtttcccttcgtaaatttgcat

SEQ ID NO: 196 - DNA, 642 bp, Artificial Sequence
  Synthetic
atgaaggccaagctgctggtgctcctgtgcaccttcaccgccacctacgccgacaccatctgcatcggctaccacgccaacaacagcaccgacaccgtggataccgtgctggaaaagaacgtgaccgtgacccacagcgtgaacctgggcagcggcctgcggatggtgacaggcctgcggaacatcccccagagagagacacggggcctgttcggcgccattgccggctttatcgagggcggctggaccggcatggtggacgggtggtacggctaccaccaccagaacgagcagggcagcggctacgccgccgaccagaagtccacccagaacgccatcaacggcatcaccaacatggtgaacagcgtgatcgagaagatgggctccggcggcagcggcaccgatctggctgaactgctggtcctgctgctgaacgagcggaccctggacttccacgacagcaacgtgaagaacctgtacgagaaagtgaagtcccagctgaagaacaacgccaaagagatcggcaacggctgcttcgagttctaccacaagtgcaacaacgagtgcatggaaagcgtgaagaacggcacctacgactaccccaagtacagcgaggaaagcaagctgaaccgcgagggaggc

SEQ ID NO: 197 - protein, 214 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREGG

SEQ ID NO: 198 - DNA, 642 bp, Artificial Sequence
  Synthetic
gcctccctcgcggttcagcttgctttcctcgctgtacttggggtagtcgtaggtgccgttcttcacgctttccatgcactcgttgttgcacttgtggtagaactcgaagcagccgttgccgatctctttggcgttgttcttcagctgggacttcactttctcgtacaggttcttcacgttgctgtcgtggaagtccagggtccgctcgttcagcagcaggaccagcagttcagccagatcggtgccgctgccgccggagcccatcttctcgatcacgctgttcaccatgttggtgatgccgttgatggcgttctgggtggacttctggtcggcggcgtagccgctgccctgctcgttctggtggtggtagccgtaccacccgtccaccatgccggtccagccgccctcgataaagccggcaatggcgccgaacaggccccgtgtctctctctgggggatgttccgcaggcctgtcaccatccgcaggccgctgcccaggttcacgctgtgggtcacggtcacgttcttttccagcacggtatccacggtgtcggtgctgttgttggcgtggtagccgatgcagatggtgtcggcgtaggtggcggtgaaggtgcacaggagcaccagcagcttggccttcat

SEQ ID NO: 199 - DNA, 1104 bp, Artificial Sequence
  Synthetic
atgaaggccaagctgctggtgctcctgtgcaccttcaccgccacctacgccgacaccatctgcatcggctaccacgccaacaacagcaccgacaccgtggataccgtgctggaaaagaacgtgaccgtgacccacagcgtgaacctgggcagcggcctgcggatggtgacaggcctgcggaacatcccccagagagagacacggggcctgttcggcgccattgccggctttatcgagggcggctggaccggcatggtggacgggtggtacggctaccaccaccagaacgagcagggcagcggctacgccgccgaccagaagtccacccagaacgccatcaacggcatcaccaacatggtgaacagcgtgatcgagaagatgggctccggcggcagcggcaccgatctggctgaactgctggtcctgctgctgaacgagcggaccctggacttccacgacagcaacgtgaagaacctgtacgagaaagtgaagtcccagctgaagaacaacgccaaagagatcggcaacggctgcttcgagttctaccacaagtgcaacaacgagtgcatggaaagcgtgaagaacggcacctacgactaccccaagtacagcgaggaaagcaagctgaaccgcgagggaggcatgcaaatctacgagggcaagctgacagccgagggcctgagattcggcatcgtggccagccggttcaaccacgccctggtggacagactggtggaaggcgccatcgactgcatcgtgcggcacggcggcagagaagaggacatcaccctggtccgcgtgcccggcagctgggaaattcctgtggctgccggcgagctggcccggaaagaggatatcgacgccgtcatcgccatcggcgtgctgatcagaggcgccaccccccacttcgactatatcgccagcgaggtgtccaagggcctggccaacctgagcctggaactgcggaagcccatcaccttcggagtgatcaccgccgacaccctggaacaggccatcgagagagccggcaccaagcacggcaacaagggatgggaagccgccctgagcgccatcgagatggccaatctgttcaagagcctgcgc

SEQ ID NO: 200 - protein, 368 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREGGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 201 - DNA, 1104 bp, Artificial Sequence
  Synthetic
gcgcaggctcttgaacagattggccatctcgatggcgctcagggcggcttcccatcccttgttgccgtgcttggtgccggctctctcgatggcctgttccagggtgtcggcggtgatcactccgaaggtgatgggcttccgcagttccaggctcaggttggccaggcccttggacacctcgctggcgatatagtcgaagtggggggtggcgcctctgatcagcacgccgatggcgatgacggcgtcgatatcctctttccgggccagctcgccggcagccacaggaatttcccagctgccgggcacgcggaccagggtgatgtcctcttctctgccgccgtgccgcacgatgcagtcgatggcgccttccaccagtctgtccaccagggcgtggttgaaccggctggccacgatgccgaatctcaggccctcggctgtcagcttgccctcgtagatttgcatgcctccctcgcggttcagcttgctttcctcgctgtacttggggtagtcgtaggtgccgttcttcacgctttccatgcactcgttgttgcacttgtggtagaactcgaagcagccgttgccgatctctttggcgttgttcttcagctgggacttcactttctcgtacaggttcttcacgttgctgtcgtggaagtccagggtccgctcgttcagcagcaggaccagcagttcagccagatcggtgccgctgccgccggagcccatcttctcgatcacgctgttcaccatgttggtgatgccgttgatggcgttctgggtggacttctggtcggcggcgtagccgctgccctgctcgttctggtggtggtagccgtaccacccgtccaccatgccggtccagccgccctcgataaagccggcaatggcgccgaacaggccccgtgtctctctctgggggatgttccgcaggcctgtcaccatccgcaggccgctgcccaggttcacgctgtgggtcacggtcacgttcttttccagcacggtatccacggtgtcggtgctgttgttggcgtggtagccgatgcagatggtgtcggcgtaggtggcggtgaaggtgcacaggagcaccagcagcttggccttcat

SEQ ID NO: 202 - DNA, 645 bp, Artificial Sequence
  Synthetic
atgaaggccaagctgctggtgctcctgtgcaccttcaccgccacctacgccgacaccatctgcatcggctaccacgccaacaacagcaccgacaccgtggataccgtgctggaaaagaacgtgaccgtgacccacagcgtgaacctgggcagcggcctgcggatggtgacaggcctgcggaacatcccccagagagagacacggggcctgttcggcgccattgccggctttatcgagggcggctggaccggcatggtggacgggtggtacggctaccaccaccagaacgagcagggcagcggctacgccgccgaccagaagtccacccagaacgccatcaacggcatcaccaacatggtgaacagcgtgatcgagaagatgggctccggcggcagcggcaccgatctggctgaactgctggtcctgctgctgaacgagcggaccctggacttccacgacagcaacgtgaagaacctgtacgagaaagtgaagtcccagctgaagaacaacgccaaagagatcggcaacggctgcttcgagttctaccacaagtgcaacaacgagtgcatggaaagcgtgaagaacggcacctacgactaccccaagtacagcgaggaaagcaagctgaaccgcgagggaagcggc

SEQ ID NO: 203 - protein, 215 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREGSG

SEQ ID NO: 204 - DNA, 645 bp, Artificial Sequence
  Synthetic
gccgcttccctcgcggttcagcttgctttcctcgctgtacttggggtagtcgtaggtgccgttcttcacgctttccatgcactcgttgttgcacttgtggtagaactcgaagcagccgttgccgatctctttggcgttgttcttcagctgggacttcactttctcgtacaggttcttcacgttgctgtcgtggaagtccagggtccgctcgttcagcagcaggaccagcagttcagccagatcggtgccgctgccgccggagcccatcttctcgatcacgctgttcaccatgttggtgatgccgttgatggcgttctgggtggacttctggtcggcggcgtagccgctgccctgctcgttctggtggtggtagccgtaccacccgtccaccatgccggtccagccgccctcgataaagccggcaatggcgccgaacaggccccgtgtctctctctgggggatgttccgcaggcctgtcaccatccgcaggccgctgcccaggttcacgctgtgggtcacggtcacgttcttttccagcacggtatccacggtgtcggtgctgttgttggcgtggtagccgatgcagatggtgtcggcgtaggtggcggtgaaggtgcacaggagcaccagcagcttggccttcat

SEQ ID NO: 205 - DNA, 1107 bp, Artificial Sequence
  Synthetic
atgaaggccaagctgctggtgctcctgtgcaccttcaccgccacctacgccgacaccatctgcatcggctaccacgccaacaacagcaccgacaccgtggataccgtgctggaaaagaacgtgaccgtgacccacagcgtgaacctgggcagcggcctgcggatggtgacaggcctgcggaacatcccccagagagagacacggggcctgttcggcgccattgccggctttatcgagggcggctggaccggcatggtggacgggtggtacggctaccaccaccagaacgagcagggcagcggctacgccgccgaccagaagtccacccagaacgccatcaacggcatcaccaacatggtgaacagcgtgatcgagaagatgggctccggcggcagcggcaccgatctggctgaactgctggtcctgctgctgaacgagcggaccctggacttccacgacagcaacgtgaagaacctgtacgagaaagtgaagtcccagctgaagaacaacgccaaagagatcggcaacggctgcttcgagttctaccacaagtgcaacaacgagtgcatggaaagcgtgaagaacggcacctacgactaccccaagtacagcgaggaaagcaagctgaaccgcgagggaagcggcatgcaaatctacgagggcaagctgacagccgagggcctgagattcggcatcgtggccagccggttcaaccacgccctggtggacagactggtggaaggcgccatcgactgcatcgtgcggcacggcggcagagaagaggacatcaccctggtccgcgtgcccggcagctgggaaattcctgtggctgccggcgagctggcccggaaagaggatatcgacgccgtcatcgccatcggcgtgctgatcagaggcgccaccccccacttcgactatatcgccagcgaggtgtccaagggcctggccaacctgagcctggaactgcggaagcccatcaccttcggagtgatcaccgccgacaccctggaacaggccatcgagagagccggcaccaagcacggcaacaagggatgggaagccgccctgagcgccatcgagatggccaatctgttcaagagcctgcgc

SEQ ID NO: 206 - protein, 369 aa, Artificial Sequence
  Synthetic
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 207 - DNA, 1107 bp, Artificial Sequence
  Synthetic
gcgcaggctcttgaacagattggccatctcgatggcgctcagggcggcttcccatcccttgttgccgtgcttggtgccggctctctcgatggcctgttccagggtgtcggcggtgatcactccgaaggtgatgggcttccgcagttccaggctcaggttggccaggcccttggacacctcgctggcgatatagtcgaagtggggggtggcgcctctgatcagcacgccgatggcgatgacggcgtcgatatcctctttccgggccagctcgccggcagccacaggaatttcccagctgccgggcacgcggaccagggtgatgtcctcttctctgccgccgtgccgcacgatgcagtcgatggcgccttccaccagtctgtccaccagggcgtggttgaaccggctggccacgatgccgaatctcaggccctcggctgtcagcttgccctcgtagatttgcatgccgcttccctcgcggttcagcttgctttcctcgctgtacttggggtagtcgtaggtgccgttcttcacgctttccatgcactcgttgttgcacttgtggtagaactcgaagcagccgttgccgatctctttggcgttgttcttcagctgggacttcactttctcgtacaggttcttcacgttgctgtcgtggaagtccagggtccgctcgttcagcagcaggaccagcagttcagccagatcggtgccgctgccgccggagcccatcttctcgatcacgctgttcaccatgttggtgatgccgttgatggcgttctgggtggacttctggtcggcggcgtagccgctgccctgctcgttctggtggtggtagccgtaccacccgtccaccatgccggtccagccgccctcgataaagccggcaatggcgccgaacaggccccgtgtctctctctgggggatgttccgcaggcctgtcaccatccgcaggccgctgcccaggttcacgctgtgggtcacggtcacgttcttttccagcacggtatccacggtgtcggtgctgttgttggcgtggtagccgatgcagatggtgtcggcgtaggtggcggtgaaggtgcacaggagcaccagcagcttggccttcat

SEQ ID NO: 208 - DNA, 645 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccaagcatccagagcagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 209 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNQWTLLFHDSNVKNLYEKVKSQLKNNAKEIGNGCFEFYHKCNNECMESVKNGTYDYPKYSEESKLNREKID

SEQ ID NO: 210 - DNA, 645 bp, Artificial Sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctctgctctggatgcttgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 211 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccaagcatccagagcagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 212 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 213 - DNA, 1149 bp, Artificial Sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctctgctctggatgcttgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 214 - protein, 215 aa, Artificial Sequence
  Synthetic
MKAKLLVLLCTFTATYADTLCIGYHANNSTDTVDTVLEKNVTVTHSVNLGSGLRLATGLRNIPSIQSRGLFGAIAGFIEGGWTGMVDGWYGYHHQNEQGSGYAADLKSTQNAIDEITNMVNSVIEKMGSGGSGTDLAELLVLLLNQWTLLYHDSNVKNLYEKVRSQLKNNAKEIGNGCFEFYHKCDNTCMESVKNGTYDYPKYSEEAKLNREKID

SEQ ID NO: 215 - protein, 383 aa, Artificial Sequence
  Synthetic
MKAKLLVLLCTFTATYADTLCIGYHANNSTDTVDTVLEKNVTVTHSVNLGSGLRLATGLRNIPSIQSRGLFGAIAGFIEGGWTGMVDGWYGYHHQNEQGSGYAADLKSTQNAIDEITNMVNSVIEKMGSGGSGTDLAELLVLLLNQWTLLYHDSNVKNLYEKVRSQLKNNAKEIGNGCFEFYHKCDNTCMESVKNGTYDYPKYSEEAKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 216 - DNA, 645 bp, Artificial sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacatacaacgctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 217 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTYNAELLVLLLNERTLDFHDSNVKNLYEKVKSQLKNNAKEIGNGCFEFYHKCNNECMESVKNGTYDYPKYSEESKLNREKID

SEQ ID NO: 218 - DNA, 645 bp, Artificial sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagcgttgtatgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 219 - DNA, 1149 bp, Artificial Sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacatacaacgctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 220 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTYNAELLVLLLNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 221 - DNA, 1151 bp, Artificial Sequence
  Synthetic
rctgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagcgttgtatgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 222 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKID

SEQ ID NO: 223 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 224 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNIVNSVIEKMGSGGSGTDLAELLVLLINERTLDFHDSNVKNLYEKVKSQLKNNAKEIGNGCFEFYHKCNNECMESVKNGTYDYPKYSEESKLNREKID

SEQ ID NO: 225 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNIVNSVIEKMGSGGSGTDLAELLVLLINERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 226 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNLVNSVIEKMGSGGSGTDLAELLVLLINERTLDFHDSNVKNLYEKVKSQLKNNAKEIGNGCFEFYHKCNNECMESVKNGTYDYPKYSEESKLNREKID

SEQ ID NO: 227 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNLVNSVIEKMGSGGSGTDLAELLVLLINERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 228 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNLVNSVIEKMGSGGSGTDLAELLVLLLNERTLDFHDSNVKNLYEKVKSQLKNNAKEIGNGCFEFYHKCNNECMESVKNGTYDYPKYSEESKLNREKID

SEQ ID NO: 229 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNLVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 230 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLMNERTLDFHDSNVKNLYEKVKSQLKNNAKEIGNGCFEFYHKCNNECMESVKNGTYDYPKYSEESKLNREKID

SEQ ID NO: 231 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLMNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 232 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNQVNSVIEKMGSGGSGTDLAELLVLLQNERTLDFHDSNVKNLYEKVKSQLKNNAKEIGNGCFEFYHKCNNECMESVKNGTYDYPKYSEESKLNREKID

SEQ ID NO: 233 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNQVNSVIEKMGSGGSGTDLAELLVLLQNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 234 - DNA, 645 bp, Artificial sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcaccaactcaactaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 235 - protein, 215 aa, Artificial Sequence
  Synthetic
MKAKLLVLLCTFTATYADTICIGYHANNSTDTVDTVLEKNVTVTNSTNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKID

SEQ ID NO: 236 - DNA, 645 bp, Artificial sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattagttgagttggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 237 - DNA, 1149 bp, Artificial sequence
  Synthetic
atgaaggccaaactgctggtcctgctgtgtacttttaccgcaacctacgctgacactatctgcatcggctatcacgcaaacaactccaccgacacagtggataccgtcctggagaagaacgtgactgtcaccaactcaactaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtca

SEQ ID NO: 238 - protein, 383 aa, Artificial Sequence
  Synthetic
MKAKLLVLLCTFTATYADTICIGYHANNSTDTVDTVLEKNVTVTNSTNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 239 - DNA, 1149 bp, Artificial sequence
  Synthetic
tgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattagttgagttggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 240 - protein, 215 aa, Artificial Sequence
  Synthetic
MKAKLLVLLCTFTATYADTICIGYHANNSTDTVDTILEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLMLNQFTLLFHDSNVKNLYEKVKSQLKNNAKEIGNGCFEFYHKCNNECMESVKNGTYDYPKYSEESKLNREKID

SEQ ID NO: 241 - protein, 383 aa, Artificial Sequence
  Synthetic
MKAKLLVLLCTFTATYADTICIGYHANNSTDTVDTILEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLMLNQFTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 242 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGNGTGGADLAELLVLLLNQWTLLFHDSNVKNLYEKVKSQLKNNAKEIGNGCFEFYHKCNNECMESVKNGTYDYPKYSEESKLNREKID

SEQ ID NO: 243 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGNGTGGADLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 244 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKID

SEQ ID NO: 245 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 246 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGNGTDLAELLVLLLNQWTLLFHDSNVKNLYEKVKSQLKNNAKEIGNGCFEFYHKCNNECMESVKNGTYDYPKYSEESKLNREKID

SEQ ID NO: 247 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGNGTDLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 248 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHNNTQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKID

SEQ ID NO: 249 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHNNTQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMNSTNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 250 - protein, 215 aa, Artificial Sequence; identical to SEQ ID NO: 248
  Synthetic

SEQ ID NO: 251 - protein, 383 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHNNTQGSGYAADQKSTQNAINGITNMVNSVIEKMGGNGTGADLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMNSTNLYMSMSSWCYTHSLDGAGLFLFDHAAEEYEHAKKLIIFLNENNVPVNLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 252 - protein, 214 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREGG

SEQ ID NO: 253 - protein, 368 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREGGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 254 - protein, 215 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREGSG

SEQ ID NO: 255 - protein, 369 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 256 - protein, 211 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLGG

SEQ ID NO: 257 - protein, 364 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLGGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 258 - protein, 212 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLGSG

SEQ ID NO: 259 - protein, 365 aa, Artificial Sequence
  Synthetic
MKAKLLVLLCTFTATYADTICIGYHANNSTDTVDTVLEKNVTVTHSVNLGSGLRMVTGLRNIPSIQSRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLGSGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 260 - DNA, 645 bp, Artificial sequence; identical to SEQ ID NO: 79
  Synthetic
  CDS (1)..(645)

SEQ ID NO: 261 - protein, 215 aa, Artificial sequence; identical to SEQ ID NO: 80
  Synthetic Construct

SEQ ID NO: 262 - DNA, 645 bp, Artificial sequence; identical to SEQ ID NO: 81
  Synthetic

SEQ ID NO: 263 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 264 - protein, 383 aa, Artificial sequence; identical to SEQ ID NO: 107
  Synthetic Construct

SEQ ID NO: 265 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 266 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 267 - DNA, 645 bp, Artificial sequence; identical to SEQ ID NO: 82
  Synthetic
  CDS (1)..(645)

SEQ ID NO: 268 - protein, 215 aa, Artificial sequence
  Synthetic Construct
MKAILVVLLYTFATANADTLCIGYHANNSTDTVDTVLEKNVTVTHSVNLGSGLRLATGLRNIPQRETRGLFGAIAGFIEGGWTGMVDGWYGYHHQNEQGSGYAADLKSTQNAIDEITNMVNSVIEKMGSGGSGTDLAELLVLLLNQWTLLYHDSNVKNLYEKVRSQLKNNAKEIGNGCFEFYHKCDNTCMESVKNGTYDYPKYSEEAKLNREEID

SEQ ID NO: 269 - DNA, 645 bp, Artificial sequence; identical to SEQ ID NO: 84
  Synthetic

SEQ ID NO: 270 - DNA, 1155 bp, Artificial sequence
  Synthetic
  CDS (1)..(1155)
atgaaggcaatcctggtcgtcctgctgtatactttcgctaccgctaacgctgacaccctgtgcatcggctatcacgctaacaactcaaccgacacagtggatactgtcctggagaagaacgtgactgtcacccactctgtgaatctgggcagtggactgaggctggcaactggactgcgaaacatcccacagcgggaaaccagaggactgttcggcgctatcgcagggtttattgagggcgggtggacaggaatggtggacgggtggtacggctaccaccatcagaacgagcagggatcaggctacgccgctgacctgaagagcacacagaatgcaatcgatgaaattactaacatggtgaattccgtcatcgagaaaatgggcagcggaggctccggaaccgacctggcagaactgctggtgctgctgctgaaccagtggacactgctgtaccacgatagtaacgtgaagaatctgtatgagaaagtccgatcacagctgaagaacaatgctaaagaaatcgggaatggatgcttcgagttttaccataagtgcgacaacacctgtatggagagcgtgaaaaatggcacatacgattatcccaagtattccgaggaagccaaactgaacagagaggaaattgactctgggggcgacatcatcaagctgctgaacgaacaggtcaacaaggagatgcagagctccaatctgtacatgtccatgtctagttggtgttatacccactctctggacggcgctgggctgttcctgtttgatcacgcagccgaggaatacgaacatgcaaagaaactgatcattttcctgaacgagaacaatgtgcccgtccagctgacatcaatcagcgcccctgaacataagttcgagggcctgactcagatctttcagaaagcttacgaacacgagcagcatatttccgaatctatcaacaatattgtggaccacgccattaagagtaaagatcatgctaccttcaattttctgcagtggtacgtggccgagcagcacgaggaggaggtcctgtttaaggacatcctggataaaatcgaactgattggaaacgagaatcatggcctgtacctggcagatcagtatgtgaagggcattgccaagagccggaaaagtgggtcatgatga

SEQ ID NO: 271 - protein, 383 aa, Artificial sequence
  Synthetic Construct
MKAILVVLLYTFATANADTLCIGYHANNSTDTVDTVLEKNVTVTHSVNLGSGLRLATGLRNIPQRETRGLFGAIAGFIEGGWTGMVDGWYGYHHQNEQGSGYAADLKSTQNAIDEITNMVNSVIEKMGSGGSGTDLAELLVLLLNQWTLLYHDSNVKNLYEKVRSQLKNNAKEIGNGCFEFYHKCDNTCMESVKNGTYDYPKYSEEAKLNREEIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 272 - DNA, 1155 bp, Artificial sequence
  Synthetic
tcatcatgacccacttttccggctcttggcaatgcccttcacatactgatctgccaggtacaggccatgattctcgtttccaatcagttcgattttatccaggatgtccttaaacaggacctcctcctcgtgctgctcggccacgtaccactgcagaaaattgaaggtagcatgatctttactcttaatggcgtggtccacaatattgttgatagattcggaaatatgctgctcgtgttcgtaagctttctgaaagatctgagtcaggccctcgaacttatgttcaggggcgctgattgatgtcagctggacgggcacattgttctcgttcaggaaaatgatcagtttctttgcatgttcgtattcctcggctgcgtgatcaaacaggaacagcccagcgccgtccagagagtgggtataacaccaactagacatggacatgtacagattggagctctgcatctccttgttgacctgttcgttcagcagcttgatgatgtcgcccccagagtcaatttcctctctgttcagtttggcttcctcggaatacttgggataatcgtatgtgccatttttcacgctctccatacaggtgttgtcgcacttatggtaaaactcgaagcatccattcccgatttctttagcattgttcttcagctgtgatcggactttctcatacagattcttcacgttactatcgtggtacagcagtgtccactggttcagcagcagcaccagcagttctgccaggtcggttccggagcctccgctgcccattttctcgatgacggaattcaccatgttagtaatttcatcgattgcattctgtgtgctcttcaggtcagcggcgtagcctgatccctgctcgttctgatggtggtagccgtaccacccgtccaccattcctgtccacccgccctcaataaaccctgcgatagcgccgaacagtcctctggtttcccgctgtgggatgtttcgcagtccagttgccagcctcagtccactgcccagattcacagagtgggtgacagtcacgttcttctccaggacagtatccactgtgtcggttgagttgttagcgtgatagccgatgcacagggtgtcagcgttagcggtagcgaaagtatacagcaggacgaccaggattgccttcat

SEQ ID NO: 273 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggcaatcctggtcgtcctgctgtatactttcgctaccgctaacgctgacaccctgtgcatcggctatcacgctaacaactcaaccgacacagtggatactgtcctggagaagaacgtgactgtcacccactctgtgaatctgggcagtggactgaggctggcaactggactgcgaaacatcccacagcgggaaaccagaggactgttcggcgctatcgcagggtttattgagggcgggtggacaggaatggtggacgggtggtacggctaccaccatcagaacgagcagggatcaggctacgccgctgacctgaagagcacacagaatgcaatcgatgaaattactaacatggtgaattccgtcatcgagaaaatgggcagcggaggctccggaaccgacctggcagaactgctggtgctgctgctgaaccagtggacactgctgtaccacgatagtaacgtgaagaatctgtatgagaaagtccgatcacagctgaagaacaatgctaaagaaatcgggaatggatgcttcgagttttaccataagtgcgacaacacctgtatggagagcgtgaaaaatggcacatacgattatcccaagtattccgaggaagccaaactgaacagagaggaaattgactctgggggcgacatcatcaagctgctgaacgaacaggtcaacaaggagatgcagagctccaatctgtacatgtccatgtctagttggtgttatacccactctctggacggcgctgggctgttcctgtttgatcacgcagccgaggaatacgaacatgcaaagaaactgatcattttcctgaacgagaacaatgtgcccgtccagctgacatcaatcagcgcccctgaacataagttcgagggcctgactcagatctttcagaaagcttacgaacacgagcagcatatttccgaatctatcaacaatattgtggaccacgccattaagagtaaagatcatgctaccttcaattttctgcagtggtacgtggccgagcagcacgaggaggaggtcctgtttaaggacatcctggataaaatcgaactgattggaaacgagaatcatggcctgtacctggcagatcagtatgtgaagggcattgccaagagccggaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 274 - DNA, 639 bp, Artificial sequence; identical to SEQ ID NO: 85
  Synthetic
  CDS (1)..(639)

SEQ ID NO: 275 - protein, 213 aa, Artificial sequence; identical to SEQ ID NO: 86
  Synthetic Construct

SEQ ID NO: 276 - DNA, 639 bp, Artificial sequence; identical to SEQ ID NO: 87
  Synthetic

SEQ ID NO: 277 - DNA, 1149 bp, Artificial sequence
  Synthetic
  CDS (1)..(1149)
atggctatcatctacctgatcctgctgttcactgctgtgcggggggaccagatttgcatcggctaccacgctaataattcaactgagaaggtggatactatcctggagcggaacgtgaccgtcacacacgctaaagacattggcagcggactggtgctggcaaccggactgaggaatgtcccacagatcgagtcccgcggactgttcggcgctatcgcagggtttattgaaggcgggtggcagggaatgattgatgggtggtacggctaccaccattctaacgaccaaggaagtggctacgccgctgataaggagagtactcagaaagccttcgatggcatcaccaacatggtgaattcagtcattgagaagatgggcagcggaggctccggaaccgacctggcagaactgctggtgctgctgctgaatcagtggacactgctgtttcacgactctaacgtgaagaatctgtatgataaagtccggatgcagctgagagacaacgtgaaggagctggggaatggatgcttcgaattttaccataagtgcgacgatgagtgtatgaacagtgtcaaaaatggcacatacgattatcccaagtatgaggaagagtcaaaactgaaccgaaatgaaatcaagagcgggggcgacatcatcaagctgctgaacgagcaagtgaataaggaaatgcagagctccaacctgtacatgtccatgtctagttggtgttatactcactctctggatggcgccgggctgttcctgtttgaccacgcagccgaagagtacgagcatgctaagaaactgatcattttcctgaacgaaaacaacgtgcccgtccagctgacatcaatcagcgcacctgagcataagttcgaaggcctgactcagatctttcagaaagcttacgagcacgaacagcatatttccgagtctatcaacaatattgtggaccacgccatcaagagcaaagatcatgctaccttcaactttctgcagtggtacgtggccgagcagcacgaagaggaagtcctgtttaaggacatcctggataaaatcgagctgattggaaacgaaaatcatggcctgtacctggcagaccagtatgtgaagggcattgccaagtccagaaaaagtgggtcatgatga

SEQ ID NO: 278 - protein, 381 aa, Artificial sequence; identical to SEQ ID NO: 113
  Synthetic Construct

SEQ ID NO: 279 - DNA, 1149 bp, Artificial sequence
  Synthetic
tcatcatgacccactttttctggacttggcaatgcccttcacatactggtctgccaggtacaggccatgattttcgtttccaatcagctcgattttatccaggatgtccttaaacaggacttcctcttcgtgctgctcggccacgtaccactgcagaaagttgaaggtagcatgatctttgctcttgatggcgtggtccacaatattgttgatagactcggaaatatgctgttcgtgctcgtaagctttctgaaagatctgagtcaggccttcgaacttatgctcaggtgcgctgattgatgtcagctggacgggcacgttgttttcgttcaggaaaatgatcagtttcttagcatgctcgtactcttcggctgcgtggtcaaacaggaacagcccggcgccatccagagagtgagtataacaccaactagacatggacatgtacaggttggagctctgcatttccttattcacttgctcgttcagcagcttgatgatgtcgcccccgctcttgatttcatttcggttcagttttgactcttcctcatacttgggataatcgtatgtgccatttttgacactgttcatacactcatcgtcgcacttatggtaaaattcgaagcatccattccccagctccttcacgttgtctctcagctgcatccggactttatcatacagattcttcacgttagagtcgtgaaacagcagtgtccactgattcagcagcagcaccagcagttctgccaggtcggttccggagcctccgctgcccatcttctcaatgactgaattcaccatgttggtgatgccatcgaaggctttctgagtactctccttatcagcggcgtagccacttccttggtcgttagaatggtggtagccgtaccacccatcaatcattccctgccacccgccttcaataaaccctgcgatagcgccgaacagtccgcgggactcgatctgtgggacattcctcagtccggttgccagcaccagtccgctgccaatgtctttagcgtgtgtgacggtcacgttccgctccaggatagtatccaccttctcagttgaattattagcgtggtagccgatgcaaatctggtccccccgcacagcagtgaacagcaggatcaggtagatgatagccat

SEQ ID NO: 280 - DNA, 5573 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatggctatcatctacctgatcctgctgttcactgctgtgcggggggaccagatttgcatcggctaccacgctaataattcaactgagaaggtggatactatcctggagcggaacgtgaccgtcacacacgctaaagacattggcagcggactggtgctggcaaccggactgaggaatgtcccacagatcgagtcccgcggactgttcggcgctatcgcagggtttattgaaggcgggtggcagggaatgattgatgggtggtacggctaccaccattctaacgaccaaggaagtggctacgccgctgataaggagagtactcagaaagccttcgatggcatcaccaacatggtgaattcagtcattgagaagatgggcagcggaggctccggaaccgacctggcagaactgctggtgctgctgctgaatcagtggacactgctgtttcacgactctaacgtgaagaatctgtatgataaagtccggatgcagctgagagacaacgtgaaggagctggggaatggatgcttcgaattttaccataagtgcgacgatgagtgtatgaacagtgtcaaaaatggcacatacgattatcccaagtatgaggaagagtcaaaactgaaccgaaatgaaatcaagagcgggggcgacatcatcaagctgctgaacgagcaagtgaataaggaaatgcagagctccaacctgtacatgtccatgtctagttggtgttatactcactctctggatggcgccgggctgttcctgtttgaccacgcagccgaagagtacgagcatgctaagaaactgatcattttcctgaacgaaaacaacgtgcccgtccagctgacatcaatcagcgcacctgagcataagttcgaaggcctgactcagatctttcagaaagcttacgagcacgaacagcatatttccgagtctatcaacaatattgtggaccacgccatcaagagcaaagatcatgctaccttcaactttctgcagtggtacgtggccgagcagcacgaagaggaagtcctgtttaaggacatcctggataaaatcgagctgattggaaacgaaaatcatggcctgtacctggcagaccagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 281 - DNA, 654 bp, Artificial sequence
  Synthetic
  CDS (1)..(654)
atggaaaaaatcgtgctgctgctggctatcgtgtccctggtgaagtccgaccagatctgtattgggtatcatgctaacaactccacagaacaggtggatactatcatggagaagaacgtgaccgtcacacacgctcaggacattggatggggactggtcctggcaaccggactgagaaattcaccacagagggaaagccggagaaagaaacgcggactgttcggcgctatcgcagggtttattgagggcgggtggcagggaatggtggatgggtggtacggctaccaccattccaacgaacagggatctggctacgccgctgataaggagtctactcagaaagctatcgacggcgtgaccaacatggtcaatagtatcattgataagatgggctctggaggcagtggaaccgacctggcagagctgctggtgctgctgctgaaccagtggacactgctgttccacgactctaacgtgaagaatctgtatgataaagtccgactgcagctgcgggacaacgccaaggaactggggaatggatgcttcgagttctaccataagtgcgataacgaatgtatggagagcatccgaaacggcacatacaattatccccagtattccgaggaagctaggctgaaacgcgaggaaattagc

SEQ ID NO: 282 - protein, 218 aa, Artificial sequence
  Synthetic Construct
MEKIVLLLAIVSLVKSDQICIGYHANNSTEQVDTIMEKNVTVTHAQDIGWGLVLATGLRNSPQRESRRKKRGLFGAIAGFIEGGWQGMVDGWYGYHHSNEQGSGYAADKESTQKAIDGVTNMVNSIIDKMGSGGSGTDLAELLVLLLNQWTLLFHDSNVKNLYDKVRLQLRDNAKELGNGCFEFYHKCDNECMESIRNGTYNYPQYSEEARLKREEIS

SEQ ID NO: 283 - DNA, 654 bp, Artificial sequence
  Synthetic
gctaatttcctcgcgtttcagcctagcttcctcggaatactggggataattgtatgtgccgtttcggatgctctccatacattcgttatcgcacttatggtagaactcgaagcatccattccccagttccttggcgttgtcccgcagctgcagtcggactttatcatacagattcttcacgttagagtcgtggaacagcagtgtccactggttcagcagcagcaccagcagctctgccaggtcggttccactgcctccagagcccatcttatcaatgatactattgaccatgttggtcacgccgtcgatagctttctgagtagactccttatcagcggcgtagccagatccctgttcgttggaatggtggtagccgtaccacccatccaccattccctgccacccgccctcaataaaccctgcgatagcgccgaacagtccgcgtttctttctccggctttccctctgtggtgaatttctcagtccggttgccaggaccagtccccatccaatgtcctgagcgtgtgtgacggtcacgttcttctccatgatagtatccacctgttctgtggagttgttagcatgatacccaatacagatctggtcggacttcaccagggacacgatagccagcagcagcacgattttttccat

SEQ ID NO: 284 - DNA, 1164 bp, Artificial sequence
  Synthetic
  CDS (1)..(1164)
atggaaaaaatcgtgctgctgctggctatcgtgtccctggtgaagtccgaccagatctgtattgggtatcatgctaacaactccacagaacaggtggatactatcatggagaagaacgtgaccgtcacacacgctcaggacattggatggggactggtcctggcaaccggactgagaaattcaccacagagggaaagccggagaaagaaacgcggactgttcggcgctatcgcagggtttattgagggcgggtggcagggaatggtggatgggtggtacggctaccaccattccaacgaacagggatctggctacgccgctgataaggagtctactcagaaagctatcgacggcgtgaccaacatggtcaatagtatcattgataagatgggctctggaggcagtggaaccgacctggcagagctgctggtgctgctgctgaaccagtggacactgctgttccacgactctaacgtgaagaatctgtatgataaagtccgactgcagctgcgggacaacgccaaggaactggggaatggatgcttcgagttctaccataagtgcgataacgaatgtatggagagcatccgaaacggcacatacaattatccccagtattccgaggaagctaggctgaaacgcgaggaaattagctccgggggagacatcattaagctgctgaacgaacaggtgaacaaggagatgcagtctagtaacctgtacatgagtatgtcaagctggtgttatactcactcactggatggcgccgggctgttcctgtttgaccacgcagccgaggaatacgaacatgctaagaaactgatcattttcctgaatgagaacaatgtgcccgtccagctgacatccatctctgcacctgaacataagttcgagggcctgactcagatctttcagaaagcctacgaacacgagcagcatattagtgagtcaatcaacaatattgtggaccacgccatcaagagcaaagatcatgctaccttcaattttctgcagtggtacgtggccgagcagcacgaggaagaggtcctgtttaaggacatcctggataaaatcgaactgattggaaacgagaatcatggcctgtacctggcagaccagtatgtgaagggcattgccaagtccaggaaaagcgggtcctgatga

SEQ ID NO: 285 - protein, 386 aa, Artificial sequence; identical to SEQ ID NO: 116
  Synthetic Construct

SEQ ID NO: 286 - DNA, 1164 bp, Artificial sequence
  Synthetic
tcatcaggacccgcttttcctggacttggcaatgcccttcacatactggtctgccaggtacaggccatgattctcgtttccaatcagttcgattttatccaggatgtccttaaacaggacctcttcctcgtgctgctcggccacgtaccactgcagaaaattgaaggtagcatgatctttgctcttgatggcgtggtccacaatattgttgattgactcactaatatgctgctcgtgttcgtaggctttctgaaagatctgagtcaggccctcgaacttatgttcaggtgcagagatggatgtcagctggacgggcacattgttctcattcaggaaaatgatcagtttcttagcatgttcgtattcctcggctgcgtggtcaaacaggaacagcccggcgccatccagtgagtgagtataacaccagcttgacatactcatgtacaggttactagactgcatctccttgttcacctgttcgttcagcagcttaatgatgtctcccccggagctaatttcctcgcgtttcagcctagcttcctcggaatactggggataattgtatgtgccgtttcggatgctctccatacattcgttatcgcacttatggtagaactcgaagcatccattccccagttccttggcgttgtcccgcagctgcagtcggactttatcatacagattcttcacgttagagtcgtggaacagcagtgtccactggttcagcagcagcaccagcagctctgccaggtcggttccactgcctccagagcccatcttatcaatgatactattgaccatgttggtcacgccgtcgatagctttctgagtagactccttatcagcggcgtagccagatccctgttcgttggaatggtggtagccgtaccacccatccaccattccctgccacccgccctcaataaaccctgcgatagcgccgaacagtccgcgtttctttctccggctttccctctgtggtgaatttctcagtccggttgccaggaccagtccccatccaatgtcctgagcgtgtgtgacggtcacgttcttctccatgatagtatccacctgttctgtggagttgttagcatgatacccaatacagatctggtcggacttcaccagggacacgatagccagcagcagcacgattttttccat

SEQ ID NO: 287 - DNA, 5588 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatggaaaaaatcgtgctgctgctggctatcgtgtccctggtgaagtccgaccagatctgtattgggtatcatgctaacaactccacagaacaggtggatactatcatggagaagaacgtgaccgtcacacacgctcaggacattggatggggactggtcctggcaaccggactgagaaattcaccacagagggaaagccggagaaagaaacgcggactgttcggcgctatcgcagggtttattgagggcgggtggcagggaatggtggatgggtggtacggctaccaccattccaacgaacagggatctggctacgccgctgataaggagtctactcagaaagctatcgacggcgtgaccaacatggtcaatagtatcattgataagatgggctctggaggcagtggaaccgacctggcagagctgctggtgctgctgctgaaccagtggacactgctgttccacgactctaacgtgaagaatctgtatgataaagtccgactgcagctgcgggacaacgccaaggaactggggaatggatgcttcgagttctaccataagtgcgataacgaatgtatggagagcatccgaaacggcacatacaattatccccagtattccgaggaagctaggctgaaacgcgaggaaattagctccgggggagacatcattaagctgctgaacgaacaggtgaacaaggagatgcagtctagtaacctgtacatgagtatgtcaagctggtgttatactcactcactggatggcgccgggctgttcctgtttgaccacgcagccgaggaatacgaacatgctaagaaactgatcattttcctgaatgagaacaatgtgcccgtccagctgacatccatctctgcacctgaacataagttcgagggcctgactcagatctttcagaaagcctacgaacacgagcagcatattagtgagtcaatcaacaatattgtggaccacgccatcaagagcaaagatcatgctaccttcaattttctgcagtggtacgtggccgagcagcacgaggaagaggtcctgtttaaggacatcctggataaaatcgaactgattggaaacgagaatcatggcctgtacctggcagaccagtatgtgaagggcattgccaagtccaggaaaagcgggtcctgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 288 - DNA, 645 bp, Artificial sequence; identical to SEQ ID NO: 216
  Synthetic
  CDS (1)..(645)

SEQ ID NO: 289 - protein, 215 aa, Artificial sequence
  Synthetic Construct
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTYNAELLVLLLNERTLDFHDSNVKNLYEKVKSQLKNNAKEIGNGCFEFYHKCNNECMESVKNGTYDYPKYSEESKLNREKID

SEQ ID NO: 290 - DNA, 645 bp, Artificial sequence; identical to SEQ ID NO: 218
  Synthetic

SEQ ID NO: 291 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacatacaacgctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 292 - protein, 383 aa, Artificial sequence
  Synthetic Construct
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTYNAELLVLLLNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 293 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagcgttgtatgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 294 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacatacaacgctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 295 - DNA, 645 bp, Artificial sequence; identical to SEQ ID NO: 91
  Synthetic
  CDS (1)..(645)

SEQ ID NO: 296 - protein, 215 aa, Artificial sequence; identical to SEQ ID NO: 92
  Synthetic Construct

SEQ ID NO: 297 - DNA, 645 bp, Artificial sequence; identical to SEQ ID NO: 93
  Synthetic

SEQ ID NO: 298 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 299 - protein, 383 aa, Artificial sequence; identical to SEQ ID NO: 119
  Synthetic Construct

SEQ ID NO: 300 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 301 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 302 - DNA, 645 bp, Artificial sequence; identical to SEQ ID NO: 163
  Synthetic
  CDS (1)..(645)

SEQ ID NO: 303 - protein, 215 aa, Artificial sequence; identical to SEQ ID NO: 164
  Synthetic Construct

SEQ ID NO: 304 - DNA, 645 bp, Artificial sequence; identical to SEQ ID NO: 165
  Synthetic

SEQ ID NO: 305 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatcgtgaattctgtcatcgaaaaaatgggcagcggaggctccggaacagacctggctgagctgctggtgctgctgatcaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 306 - protein, 383 aa, Artificial sequence; identical to SEQ ID NO: 167
  Synthetic Construct

SEQ ID NO: 307 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttgatcagcagcaccagcagctcagccaggtctgttccggagcctccgctgcccattttttcgatgacagaattcacgatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 308 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatcgtgaattctgtcatcgaaaaaatgggcagcggaggctccggaacagacctggctgagctgctggtgctgctgatcaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 309 - DNA, 645 bp, Artificial sequence; identical to SEQ ID NO: 169
  Synthetic
  CDS (1)..(645)

SEQ ID NO: 310 - protein, 215 aa, Artificial sequence; identical to SEQ ID NO: 170
  Synthetic Construct

SEQ ID NO: 311 - DNA, 645 bp, Artificial sequence; identical to SEQ ID NO: 171
  Synthetic

SEQ ID NO: 312 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacctggtgaattctgtcatcgaaaaaatgggcagcggaggctccggaacagacctggctgagctgctggtgctgctgatcaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 313 - protein, 383 aa, Artificial sequence; identical to SEQ ID NO: 173
  Synthetic Construct

SEQ ID NO: 314 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttgatcagcagcaccagcagctcagccaggtctgttccggagcctccgctgcccattttttcgatgacagaattcaccaggttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 315 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacctggtgaattctgtcatcgaaaaaatgggcagcggaggctccggaacagacctggctgagctgctggtgctgctgatcaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 316 - DNA, 645 bp, Artificial sequence; identical to SEQ ID NO: 175
  Synthetic
  CDS (1)..(645)

SEQ ID NO: 317 - protein, 215 aa, Artificial sequence; identical to SEQ ID NO: 176
  Synthetic Construct

SEQ ID NO: 318 - DNA, 645 bp, Artificial sequence; identical to SEQ ID NO: 177
  Synthetic

SEQ ID NO: 319 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacctggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 320 - protein, 383 aa, Artificial sequence; identical to SEQ ID NO: 179
  Synthetic Construct

SEQ ID NO: 321 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagccaggtctgttccggagcctccgctgcccattttttcgatgacagaattcaccaggttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 322 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacctggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 323 - DNA, 645 bp, Artificial sequence; identical to SEQ ID NO: 157
  Synthetic
  CDS (1)..(645)

SEQ ID NO: 324 - protein, 215 aa, Artificial sequence; identical to SEQ ID NO: 158
  Synthetic Construct

SEQ ID NO: 325 - DNA, 645 bp, Artificial sequence; identical to SEQ ID NO: 159
  Synthetic

SEQ ID NO: 326 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgatgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 327 - protein, 383 aa, Artificial sequence; identical to SEQ ID NO: 161
  Synthetic Construct

SEQ ID NO: 328 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcatcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 329 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgatgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 330 - DNA, 645 bp, Artificial sequence
  Synthetic
  CDS (1)..(645)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaaccaggtgaattctgtcatcgaaaaaatgggcagcggaggctccggaacagacctggctgagctgctggtgctgctgcagaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 331 - protein, 215 aa, Artificial sequence
  Synthetic Construct
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNQVNSVIEKMGSGGSGTDLAELLVLLQNERTLDFHDSNVKNLYEKVKSQLKNNAKEIGNGCFEFYHKCNNECMESVKNGTYDYPKYSEESKLNREKID

SEQ ID NO: 332 - DNA, 645 bp, Artificial sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttctgcagcagcaccagcagctcagccaggtctgttccggagcctccgctgcccattttttcgatgacagaattcacctggttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 333 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaaccaggtgaattctgtcatcgaaaaaatgggcagcggaggctccggaacagacctggctgagctgctggtgctgctgcagaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 334 - protein, 383 aa, Artificial sequence
  Synthetic Construct
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNQVNSVIEKMGSGGSGTDLAELLVLLQNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 335 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttctgcagcagcaccagcagctcagccaggtctgttccggagcctccgctgcccattttttcgatgacagaattcacctggttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 336 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaaccaggtgaattctgtcatcgaaaaaatgggcagcggaggctccggaacagacctggctgagctgctggtgctgctgcagaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 337 - DNA, 645 bp, Artificial sequence; identical to SEQ ID NO: 234
  Synthetic
  CDS (1)..(645)

SEQ ID NO: 338 - protein, 215 aa, Artificial sequence
  Synthetic Construct
MKAKLLVLLCTFTATYADTICIGYHANNSTDTVDTVLEKNVTVTNSTNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKID

SEQ ID NO: 339 - DNA, 645 bp, Artificial sequence; identical to SEQ ID NO: 236
  Synthetic

SEQ ID NO: 340 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcaccaactcaactaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 341 - protein, 383 aa, Artificial sequence
  Synthetic Construct
MKAKLLVLLCTFTATYADTICIGYHANNSTDTVDTVLEKNVTVTNSTNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 342 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaaatccagagtccgctcgttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattagttgagttggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 343 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcaccaactcaactaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaacgagcggactctggatttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 344 - DNA, 645 bp, Artificial sequence; identical to SEQ ID NO: 94
  Synthetic
  CDS (1)..(645)

SEQ ID NO: 345 - protein, 215 aa, Artificial sequence; identical to SEQ ID NO: 95
  Synthetic Construct

SEQ ID NO: 346 - DNA, 645 bp, Artificial sequence; identical to SEQ ID NO: 96
  Synthetic

SEQ ID NO: 347 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccattctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgatgctgaaccagttcactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 348 - protein, 383 aa, Artificial sequence; identical to SEQ ID NO: 122
  Synthetic Construct

SEQ ID NO: 349 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtgaactggttcagcatcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccagaatggtatccactgtgtcggtggagttgtttgcgtgatagccgatgcagatagtgtcagcgtaggttgcggtaaaagtacacagcaggaccagcagtttggccttcat

SEQ ID NO: 350 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccattctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgatgctgaaccagttcactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 351 - DNA, 645 bp, Artificial sequence; identical to SEQ ID NO: 97
  Synthetic
  CDS (1)..(645)

SEQ ID NO: 352 - protein, 215 aa, Artificial sequence; identical to SEQ ID NO: 98
  Synthetic Construct

SEQ ID NO: 353 - DNA, 645 bp, Artificial sequence; identical to SEQ ID NO: 99
  Synthetic

SEQ ID NO: 354 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcaatggaacaggcggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 355 - protein, 383 aa, Artificial sequence; identical to SEQ ID NO: 125
  Synthetic Construct

SEQ ID NO: 356 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccgcctgttccattgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 357 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcaatggaacaggcggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 358 - DNA, 645 bp, Artificial sequence; identical to SEQ ID NO: 100
  Synthetic
  CDS (1)..(645)

SEQ ID NO: 359 - protein, 215 aa, Artificial sequence; identical to SEQ ID NO: 101
  Synthetic Construct

SEQ ID NO: 360 - DNA, 645 bp, Artificial sequence; identical to SEQ ID NO: 102
  Synthetic

SEQ ID NO: 361 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 362 - protein, 383 aa, Artificial sequence; identical to SEQ ID NO: 128
  Synthetic Construct

SEQ ID NO: 363 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccagtgccatttccgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 364 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 365 - DNA, 645 bp, Artificial sequence; identical to SEQ ID NO: 103
  Synthetic
  CDS (1)..(645)

SEQ ID NO: 366 - protein, 215 aa, Artificial sequence; identical to SEQ ID NO: 104
  Synthetic Construct

SEQ ID NO: 367 - DNA, 645 bp, Artificial sequence; identical to SEQ ID NO: 105
  Synthetic

SEQ ID NO: 368 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggcaacggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 369 - protein, 383 aa, Artificial sequence; identical to SEQ ID NO: 131
  Synthetic Construct

SEQ ID NO: 370 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccgttgcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 371 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggcaacggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 372 - DNA, 645 bp, Artificial sequence; identical to SEQ ID NO: 181
  Synthetic
  CDS (1)..(645)

SEQ ID NO: 373 - protein, 215 aa, Artificial sequence; identical to SEQ ID NO: 182
  Synthetic Construct

SEQ ID NO: 374 - DNA, 645 bp, Artificial sequence; identical to SEQ ID NO: 183
  Synthetic

SEQ ID NO: 375 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccataacaatacccagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgaacagcaccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 376 - protein, 383 aa, Artificial sequence; identical to SEQ ID NO: 185
  Synthetic Construct

SEQ ID NO: 377 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggtgctgttcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccagtgccatttccgcccattttttcgatgacagaattcaccatgttagtaatgccattgattgcgttctgtgtagacttctgatcagcggcgtagccgctgccctgggtattgttatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 378 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccataacaatacccagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgaacagcaccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 379 - DNA, 645 bp, Artificial sequence; identical to SEQ ID NO: 181
  Synthetic
  CDS (1)..(645)

SEQ ID NO: 380 - protein, 215 aa, Artificial sequence; identical to SEQ ID NO: 182
  Synthetic Construct

SEQ ID NO: 381 - DNA, 645 bp, Artificial sequence; identical to SEQ ID NO: 183
  Synthetic

SEQ ID NO: 382 - DNA, 1155 bp, Artificial sequence
  Synthetic
  CDS (1)..(1155)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccataacaatacccagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgaacagcaccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtcaacctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 383 - protein, 383 aa, Artificial sequence; identical to SEQ ID NO: 191
  Synthetic Construct

SEQ ID NO: 384 - DNA, 1155 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcaggttgacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggtgctgttcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtcagctccagtgccatttccgcccattttttcgatgacagaattcaccatgttagtaatgccattgattgcgttctgtgtagacttctgatcagcggcgtagccgctgccctgggtattgttatggtggtagccgtaccacccgtccaccattcctgtccacccgccctcaataaaccctgcgatagcgccgaacagtcctcttgtttcccgctgtgggatgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 385 - DNA, 5579 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacatcccacagcgggaaacaagaggactgttcggcgctatcgcagggtttattgagggcgggtggacaggaatggtggacgggtggtacggctaccaccataacaatacccagggcagcggctacgccgctgatcagaagtctacacagaacgcaatcaatggcattactaacatggtgaattctgtcatcgaaaaaatgggcggaaatggcactggagctgacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgaacagcaccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtcaacctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 386 - DNA, 384 bp, Artificial sequence
  Synthetic
  CDS (1)..(384)
atgaaggccaagctgctggtgctcctgtgcaccttcaccgccacctacgccgacaccatctgcatcggctaccacgccaacaacagcaccgacaccgtggataccgtgctggaaaagaacgtgaccgtgacccacagcgtgaacctgggcagcggcctgcggatggtgacaggcctgcggaacatcccccagagagagacacggggcctgttcggcgccattgccggctttatcgagggcggctggaccggcatggtggacgggtggtacggctaccaccaccagaacgagcagggcagcggctacgccgccgaccagaagtccacccagaacgccatcaacggcatcaccaacatggtgaacagcgtgatcgagaagatgggc

SEQ ID NO: 387 - protein, 128 aa, Artificial sequence
  Synthetic Construct
MKAKLLVLLCTFTATYADTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMG

SEQ ID NO: 388 - DNA, 384 bp, Artificial sequence
  Synthetic
gcccatcttctcgatcacgctgttcaccatgttggtgatgccgttgatggcgttctgggtggacttctggtcggcggcgtagccgctgccctgctcgttctggtggtggtagccgtaccacccgtccaccatgccggtccagccgccctcgataaagccggcaatggcgccgaacaggccccgtgtctctctctgggggatgttccgcaggcctgtcaccatccgcaggccgctgcccaggttcacgctgtgggtcacggtcacgttcttttccagcacggtatccacggtgtcggtgctgttgttggcgtggtagccgatgcagatggtgtcggcgtaggtggcggtgaaggtgcacaggagcaccagcagcttggccttcat

SEQ ID NO: 389 - DNA, 1110 bp, Artificial sequence
  Synthetic
  CDS (1)..(1110)
atgaaggccaagctgctggtgctcctgtgcaccttcaccgccacctacgccgacaccatctgcatcggctaccacgccaacaacagcaccgacaccgtggataccgtgctggaaaagaacgtgaccgtgacccacagcgtgaacctgggcagcggcctgcggatggtgacaggcctgcggaacatcccccagagagagacacggggcctgttcggcgccattgccggctttatcgagggcggctggaccggcatggtggacgggtggtacggctaccaccaccagaacgagcagggcagcggctacgccgccgaccagaagtccacccagaacgccatcaacggcatcaccaacatggtgaacagcgtgatcgagaagatgggctccggcggcagcggcaccgatctggctgaactgctggtcctgctgctgaacgagcggaccctggacttccacgacagcaacgtgaagaacctgtacgagaaagtgaagtcccagctgaagaacaacgccaaagagatcggcaacggctgcttcgagttctaccacaagtgcaacaacgagtgcatggaaagcgtgaagaacggcacctacgactaccccaagtacagcgaggaaagcaagctgaaccgcgagggaggcatgcaaatctacgagggcaagctgacagccgagggcctgagattcggcatcgtggccagccggttcaaccacgccctggtggacagactggtggaaggcgccatcgactgcatcgtgcggcacggcggcagagaagaggacatcaccctggtccgcgtgcccggcagctgggaaattcctgtggctgccggcgagctggcccggaaagaggatatcgacgccgtcatcgccatcggcgtgctgatcagaggcgccaccccccacttcgactatatcgccagcgaggtgtccaagggcctggccaacctgagcctggaactgcggaagcccatcaccttcggagtgatcaccgccgacaccctggaacaggccatcgagagagccggcaccaagcacggcaacaagggatgggaagccgccctgagcgccatcgagatggccaatctgttcaagagcctgcgctgatga

SEQ ID NO: 390 - protein, 368 aa, Artificial sequence; identical to SEQ ID NO: 200
  Synthetic Construct

SEQ ID NO: 391 - DNA, 1110 bp, Artificial sequence
  Synthetic
tcatcagcgcaggctcttgaacagattggccatctcgatggcgctcagggcggcttcccatcccttgttgccgtgcttggtgccggctctctcgatggcctgttccagggtgtcggcggtgatcactccgaaggtgatgggcttccgcagttccaggctcaggttggccaggcccttggacacctcgctggcgatatagtcgaagtggggggtggcgcctctgatcagcacgccgatggcgatgacggcgtcgatatcctctttccgggccagctcgccggcagccacaggaatttcccagctgccgggcacgcggaccagggtgatgtcctcttctctgccgccgtgccgcacgatgcagtcgatggcgccttccaccagtctgtccaccagggcgtggttgaaccggctggccacgatgccgaatctcaggccctcggctgtcagcttgccctcgtagatttgcatgcctccctcgcggttcagcttgctttcctcgctgtacttggggtagtcgtaggtgccgttcttcacgctttccatgcactcgttgttgcacttgtggtagaactcgaagcagccgttgccgatctctttggcgttgttcttcagctgggacttcactttctcgtacaggttcttcacgttgctgtcgtggaagtccagggtccgctcgttcagcagcaggaccagcagttcagccagatcggtgccgctgccgccggagcccatcttctcgatcacgctgttcaccatgttggtgatgccgttgatggcgttctgggtggacttctggtcggcggcgtagccgctgccctgctcgttctggtggtggtagccgtaccacccgtccaccatgccggtccagccgccctcgataaagccggcaatggcgccgaacaggccccgtgtctctctctgggggatgttccgcaggcctgtcaccatccgcaggccgctgcccaggttcacgctgtgggtcacggtcacgttcttttccagcacggtatccacggtgtcggtgctgttgttggcgtggtagccgatgcagatggtgtcggcgtaggtggcggtgaaggtgcacaggagcaccagcagcttggccttcat

SEQ ID NO: 392 - DNA, 5528 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagccaccatgaaggccaagctgctggtgctcctgtgcaccttcaccgccacctacgccgacaccatctgcatcggctaccacgccaacaacagcaccgacaccgtggataccgtgctggaaaagaacgtgaccgtgacccacagcgtgaacctgggcagcggcctgcggatggtgacaggcctgcggaacatcccccagagagagacacggggcctgttcggcgccattgccggctttatcgagggcggctggaccggcatggtggacgggtggtacggctaccaccaccagaacgagcagggcagcggctacgccgccgaccagaagtccacccagaacgccatcaacggcatcaccaacatggtgaacagcgtgatcgagaagatgggctccggcggcagcggcaccgatctggctgaactgctggtcctgctgctgaacgagcggaccctggacttccacgacagcaacgtgaagaacctgtacgagaaagtgaagtcccagctgaagaacaacgccaaagagatcggcaacggctgcttcgagttctaccacaagtgcaacaacgagtgcatggaaagcgtgaagaacggcacctacgactaccccaagtacagcgaggaaagcaagctgaaccgcgagggaggcatgcaaatctacgagggcaagctgacagccgagggcctgagattcggcatcgtggccagccggttcaaccacgccctggtggacagactggtggaaggcgccatcgactgcatcgtgcggcacggcggcagagaagaggacatcaccctggtccgcgtgcccggcagctgggaaattcctgtggctgccggcgagctggcccggaaagaggatatcgacgccgtcatcgccatcggcgtgctgatcagaggcgccaccccccacttcgactatatcgccagcgaggtgtccaagggcctggccaacctgagcctggaactgcggaagcccatcaccttcggagtgatcaccgccgacaccctggaacaggccatcgagagagccggcaccaagcacggcaacaagggatgggaagccgccctgagcgccatcgagatggccaatctgttcaagagcctgcgctgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 393 - DNA, 594 bp, Artificial sequence
  Synthetic
  CDS (1)..(594)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacgggtcaggctggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgac

SEQ ID NO: 394 - protein, 198 aa, Artificial sequence
  Synthetic Construct
MKAKLLVLLCTFTATYADTICIGYHANNSTDTVDTVLEKNVTVTHSVNLGSGLRMVTGLRNGSGWTGMVDGWYGYHHQNEQGSGYAADQKSTQNAINGITNMVNSVIEKMGSGGSGTDLAELLVLLLNQWTLLFHDSNVKNLYEKVKSQLKNNAKEIGNGCFEFYHKCNNECMESVKNGTYDYPKYSEESKLNREKID

SEQ ID NO: 395 - DNA, 594 bp, Artificial sequence
  Synthetic
gtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccagcctgacccgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 396 - DNA, 1104 bp, Artificial sequence
  Synthetic
  CDS (1)..(1104)
atgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacgggtcaggctggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatga

SEQ ID NO: 397 - protein, 366 aa, Artificial sequence
  Synthetic Construct
MKAKLLVLLCTFTATYADTICIGYHANNSTDTVDTVLEKNVTVTHSVNLGSGLRMVTGLRNGSGWTGMVDGWYGYHHQNEQGSGYAADQKSTQNAINGITNMVNSVIEKMGSGGSGTDLAELLVLLLNQWTLLFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 398 - DNA, 1104 bp, Artificial sequence
  Synthetic
tcatcatgacccactttttctggacttggcaatgcccttcacatactgatctgccaggtacaggccatgattctcgtttccaatcagttcgattttatccaggatgtccttaaacaggacctcctcctcgtgctgctcggccacgtaccactgcagaaagttgaaggtagcatgatctttgctcttaatggcgtggtccacaatattgttgatagattcggaaatatgctgctcgtgttcgtaagctttctgaaagatctgggtcaggccctcgaacttatgttcaggggcgctgattgaagtcagctggacgggcacattgttctcattcaggaaaatgatcagtttctttgcatgttcgtattcctcggctgcgtgatcaaacaggaacagcccagcgccgtccagtgagtgtgtataacaccaactagacatactcatgtacaggttggagctctgcatctccttgttcacctgttcgttcagcagcttgatgatgtcgcccccactgtcaattttctctcgattcagcttactctcttcagaatatttgggatagtcgtaagtgccgttcttcacagactccatacattcattgttgcacttatggtaaaactcgaagcatccattcccgatttctttggcattgttcttcagctgggatttgaccttctcatacagattcttcacgttgctatcgtggaacagcagagtccactggttcagcagcagcaccagcagctcagccaggtctgttccggagcctccgctgcccattttttcgatgacagaattcaccatgttagtaatgccattgattgcgttctgtgtagacttctgatcagcggcgtagccgctgccctgctcattctgatggtggtagccgtaccacccgtccaccattcctgtccagcctgacccgttgcgcagtccggtgaccatcctcagtccgctgcccagattcactgagtgggtgacagtcacgttcttctccaggacggtatccactgtgtcggtggagttgtttgcgtgatagccgatgcagatagtgtcagcgtaggttgcggtaaaagtacacagcaggaccagcagtttggccttcat

SEQ ID NO: 399 - DNA, 5528 bp, Artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagagatatcgccaccatgaaggccaaactgctggtcctgctgtgtacttttaccgcaacctacgctgacactatctgcatcggctatcacgcaaacaactccaccgacacagtggataccgtcctggagaagaacgtgactgtcacccactcagtgaatctgggcagcggactgaggatggtcaccggactgcgcaacgggtcaggctggacaggaatggtggacgggtggtacggctaccaccatcagaatgagcagggcagcggctacgccgctgatcagaagtctacacagaacgcaatcaatggcattactaacatggtgaattctgtcatcgaaaaaatgggcagcggaggctccggaacagacctggctgagctgctggtgctgctgctgaaccagtggactctgctgttccacgatagcaacgtgaagaatctgtatgagaaggtcaaatcccagctgaagaacaatgccaaagaaatcgggaatggatgcttcgagttttaccataagtgcaacaatgaatgtatggagtctgtgaagaacggcacttacgactatcccaaatattctgaagagagtaagctgaatcgagagaaaattgacagtgggggcgacatcatcaagctgctgaacgaacaggtgaacaaggagatgcagagctccaacctgtacatgagtatgtctagttggtgttatacacactcactggacggcgctgggctgttcctgtttgatcacgcagccgaggaatacgaacatgcaaagaaactgatcattttcctgaatgagaacaatgtgcccgtccagctgacttcaatcagcgcccctgaacataagttcgagggcctgacccagatctttcagaaagcttacgaacacgagcagcatatttccgaatctatcaacaatattgtggaccacgccattaagagcaaagatcatgctaccttcaactttctgcagtggtacgtggccgagcagcacgaggaggaggtcctgtttaaggacatcctggataaaatcgaactgattggaaacgagaatcatggcctgtacctggcagatcagtatgtgaagggcattgccaagtccagaaaaagtgggtcatgatgaacacgtgggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 400 - protein, 198 aa, Artificial sequence; identical to SEQ ID NO: 394
  Synthetic

SEQ ID NO: 401 - protein, 366 aa, Artificial sequence; identical to SEQ ID NO: 397
  Synthetic

What is claimed is:

1. A nanoparticle comprising a protein construct that comprises an HA protein domain and a linker sequence, wherein the HA protein domain comprises the sequence of an influenza hemagglutinin (HA) protein that lacks at least 95% of the head region amino acid sequence, and in place of the missing sequence comprises a linker sequence, wherein the linker sequence is less than 10 amino acids in length; and,
   wherein the HA protein comprises at least one alteration selected from the group consisting of:
   a. deletion of the amino acid region corresponding to amino acids N403-W435 of SEQ ID NO:8; and,
   b. substitution of at least one amino acid residue in a pair of amino acid residues, wherein the amino acid residues correspond to K1 and E53 of SEQ ID NO:149; and, wherein the strength of the bond between the amino acid pair in the folded, altered protein is greater than the strength of the bond between the amino acid pair in the folded, wild-type protein.

2. The nanoparticle of claim 1, wherein a substitution is made at the position corresponding to K1, and a second substitution is made at the position corresponding to position E53.

3. The nanoparticle of claim 1, wherein the linker sequence comprises less than 5 contiguous amino acids from the head region of an influenza HA protein.

4. The nanoparticle of claim 1, wherein the HA protein domain is joined to a monomeric subunit protein that allows the protein construct to form a nanoparticle.

5. The nanoparticle of claim 1, wherein the HA protein domain comprises a first amino acid sequence from the stem region of the influenza virus hemagglutinin (HA) protein and a second amino acid sequence from the stem region of the influenza virus hemagglutinin (HA) protein, the first and second amino acid sequences being covalently linked by the linker sequence,
   wherein the first amino acid sequence comprises at least 20 contiguous amino acid residues from the amino acid sequence upstream of the amino-terminal end of the head
   wherein the second amino acid sequence comprises at least 20 contiguous amino acid residues from the amino acid sequence downstream of the carboxyl-terminal end of the head region sequence.

6. The nanoparticle of claim 5, wherein the first amino acid sequence and the second amino acid sequence are from the stem region of an influenza HA protein from a virus selected from the group consisting of A/New Caledonia/20/1999 (1999 NC, H1), A/California/04/2009 (2009 CA, H1), A/Singapore/1/1957 (1957 Sing, H2), A/Hong Kong/1/1968 (1968 HK, H3), A/Brisbane/10/2007 (2007 Bris, H3), A/Indonesia/05/2005 (2005 Indo, H5), B/Florida/4/2006 (2006 Flo, B), A/Perth/16/2009 (2009 Per, H3), A/Brisbane/59/2007 (2007 Bris, H1), B/Brisbane/60/2008 (2008 Bris, B).

7. The nanoparticle of claim 5, wherein the first amino acid sequence comprises a sequence at least 80% identical to at least 40 contiguous amino acid residues from a sequence selected from the group consisting of SEQ ID NO: 20, SEQ ID NO:35, SEQ ID NO:50 and SEQ ID NO:65.

8. The nanoparticle of claim 5, wherein the second amino acid sequence comprises a sequence at least 80% identical to at least 40 contiguous amino acid residues from a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77.

9. The nanoparticle of claim 5, wherein the second amino acid sequence comprises at least 60 contiguous amino acids from the amino acid sequence downstream of the carboxyl-terminal end of the head region sequence; and,
   wherein the 60 contiguous amino acids comprise a polypeptide sequence corresponding to the sequence of SEQ ID NO:149 or SEQ ID NO:150 from H1N1 NC.

10. The nanoparticle of claim 1, wherein the first amino acid sequence comprises a sequence selected from the group consisting of SEQ ID NO: 20, SEQ ID NO:35, SEQ ID NO:50 and SEQ ID NO:65; and, wherein the second amino acid sequence comprises a sequence selected from the group consisting of SEQ ID NO:23, SEQ ID NO:26, SEQ ID NO:29, SEQ ID NO:32, SEQ ID NO:38, SEQ ID NO:41, SEQ ID NO:44, SEQ ID NO:47, SEQ ID NO:53, SEQ ID NO:56, SEQ ID NO:59, SEQ ID NO:62, SEQ ID NO:68, SEQ ID NO:71, SEQ ID NO:74 and SEQ ID NO:77.

11. The nanoparticle of claim 1, wherein the HA protein comprises at least one other mutation at an amino acid position corresponding to an amino acid position in SEQ ID NO:8 selected from the group consisting of amino acid position 36, amino acid position 45, amino acid position 47, amino acid position 49, amino acid position 339, amino acid position 340, amino acid position 341, amino acid position 342, amino acid position 361, amino acid position 372, amino acid position 394, amino acid position 402, amino acid position 437, amino acid position 438, amino acid position 445, amino acid position 446, amino acid position 448, amino acid 449, amino acid position 450 and amino acid position 452.

12. The nanoparticle of claim 1, wherein the nanoparticle is a multivalent nanoparticle.

13. A kit comprising the nanoparticle of claim 1.

14. A method to vaccinate an individual against influenza virus, comprising administering to the individual the nanoparticle of claim 1.

15. A method of detecting anti-influenza antibodies, comprising:
   a. contacting at least a portion of a sample being tested for the presence of anti-influenza antibodies with the nanoparticle of claim 1; and,
   b. detecting the presence of a nanoparticle/antibody complex;
   wherein the presence of a nanoparticle/antibody complex indicates that the sample contains anti-influenza antibodies.

16. A method of identifying an individual having anti-influenza virus antibodies, comprising:
   a. contacting at least a portion of a sample from an individual with the nanoparticle of claim 1 to form a mixture;
   b. analyzing the mixture for the presence of an anti-influenza virus antibody/nanoparticle complex; and,
   c. identifying the individual as having anti-influenza antibodies if an anti-influenza virus antibody/nanoparticle complex is detected.

17. A method of determining the response of an individual to a vaccine, comprising:
   a. contacting at least a portion of a post-vaccination sample from an individual with the nanoparticle of claim 1 to form a mixture; and,
   b. analyzing the mixture for the presence or level of an anti-influenza virus antibody/nanoparticle complex;

wherein the presence or level of an anti-influenza virus antibody/nanoparticle complex indicates the presence or level of recent anti-influenza antibodies; and, wherein an increase in the level of anti-influenza antibodies in the sample over the presence of level of antibodies in a pre-vaccination sample from the individual, indicates that the vaccine induced in the individual, an immune response to influenza virus.

18. The nanoparticle of claim 2, wherein the amino acid residue corresponding to K1 of SEQ ID NO:149 is substituted with a leucine, an isoleucine, a methionine, or a glutamine, and wherein the amino acid residue corresponding to E53 of SEQ ID NO:149 is substituted with a leucine, an isoleucine, a methionine, or a glutamine.

\* \* \* \* \*